United States Patent 11,098,302 (IDENTIFICATION OF POLYNUCLEOTIDES ASSOCIATED WITH A SAMPLE) - sequence listing, part 112

SEQ ID NO: 386212 - DNA, 517 bp, Homo sapiens
  misc_feature: GZ8MTXP01B4S31.22.86.H09.1.454.CMB.2.raw
  modified_base (309)..(309): a, c, t, g, unknown or other
  modified_base (493)..(493): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtggctatggcatgcactggctccgcaggctccgggnaagggggctgggagtggggtgacctaagttagtatggtatgatggaaataataagactatgtgactcgtagaacggcgattcacatctccagacgacaactccaagaactacttactgtttacctaccaaagtgaaaccagcctagacggacggcgaaggacaggcagtgtattacgttggttncgagaagatcgataattggaaccg

SEQ ID NO: 386213 - DNA, 634 bp, Homo sapiens
  misc_feature: GZ8MTXP01CD7BF.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaaggggctgggagtggggtggcaattatatggtatgatggaaagtaataaagactatgtgactcgtgaaggcgattcacatctccagagacaactccaaagaacactctcgtttcacaaatgaacaacgcctgagagggcgaaggacacgggcagttgtattacgtgtgcgagaacgatcgacagtacgaacgtaacggggaaaagttcctttttggaatttccgtcggtagggggaccccaaagggggacctaacgttcgggtacccacccggttccttccgtttccgaacggccccttaccccgaaccggtaaacggggcccccttaacgttccccggggttcccctttcccccccgtggggtccccgtcccccgtcggttacccgtcccgaaggggtaaccccg

SEQ ID NO: 386214 - DNA, 533 bp, Homo sapiens
  misc_feature: GZ8MTXP01AFBYB.22.86.H09.1.454.CMB.2.raw
  modified_base (256)..(256): a, c, t, g, unknown or other
  modified_base (301)..(301): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgtatactatgtctcnggtaccaacagcacccaggcaaacgcccccagactcatcatttangctgtcaatagcgcctcgacggggtccccctgatcgcttctctggctccaagtctggcaacacgccctccctgaccatctcgtgggcctccgagctagaagatgaggctgattatactgtctgctctatttcgctaggccgtcctacgttacgtttgggttcgttcgggcgggacgggaccttaaggcctggaacccgttccgtacgggttcctaacggccccgtaaccggg

SEQ ID NO: 386215 - DNA, 632 bp, Homo sapiens
  misc_feature: GZ8MTXP01C4RW9.22.86.H09.1.454.CMB.2.raw
  modified_base (274)..(274): a, c, t, g, unknown or other
  modified_base (316)..(316): a, c, t, g, unknown or other
  modified_base (409)..(409): a, c, t, g, unknown or other
  modified_base (451)..(451): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtgacaattatatggtatgatggaaagtaanaaagactatgtggactcgtgaaggccattcacatctccaganacaactaccaaagacactctgtttacacaaatgaacaagcctgagagggacgacggacacggacagtagttatactgtgcgaagagatacganagtagaacgtaagggaaagttcgttttagaactcgttacggnggggacccgaaagggcgtaaaccgttgggtacctaacccgttcctaccgtttccgaacgttccccggttaaccccaaccggtaaaccggggtccccttaaacggttcccgggttacccccttttcccccccggcgggttccccgaccccgttcgggcccttaacccgggaacgggaacccg

SEQ ID NO: 386216 - DNA, 561 bp, Homo sapiens
  misc_feature: GZ8MTXP01AFFW0.22.86.H09.1.454.CMB.2.raw
  modified_base (343)..(343): a, c, t, g, unknown or other
  modified_base (534)..(534): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtgcaattatatggtatgatggaagtaataaagactatgtggactcgtgaagggccgattcaccatctccagagacaactccaagacactctcgtttcncaaatgaacaagcctgagaggcgaggacacggcagtgtattactgtgcgagagatcgacatgaacgtacgggtaaagtcgttttagatcgtacgtcgggggccaaaggggacctaacgtgggtccacccggttctcgttcacgttccctacccaccgtaaacgggccccagttccggttcccttcccccgnggcccgccctgcctccgaagggaaccg

SEQ ID NO: 386217 - DNA, 544 bp, Homo sapiens
  misc_feature: GZ8MTXP01EEVCN.22.86.H09.1.454.CMB.2.raw
  modified_base (311)..(311): a, c, t, g, unknown or other
  modified_base (490)..(490): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctggggaggtccctgagactctcctgtgcagcgtctggatcaccttcagtgctatggcatgcacgtggcctccgcaggctccgggnaagggggctgggaggtggggtgacctaattatagtggtaatggatgggaaagtaaactaaagactatggtagactcgtagaaggcgattcactatctaccagacaacaactaccaaagaactacttcttacttacctaccaaatacgaacagcctaggagacgggcgaaggacgacggnttagtgtaattagttgttggaacgaggaagtagcgaactaagttaagtaaacgg

SEQ ID NO: 386218 - DNA, 648 bp, Homo sapiens
  misc_feature: GZ8MTXP01EABOH.22.86.H09.1.454.CMB.2.raw
  modified_base (293)..(293): a, c, t, g, unknown or other
  modified_base (398)..(398): a, c, t, g, unknown or other
  modified_base (406)..(406): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgcaggcgtccgggacgaaggggctgggaggtggggtgacaattatatggtatgatggaaataaataaagactatggngactccgtagaaagggccgattcaccatctaccagacgaacaactaccaaagaacactcttcgttcacaaatgaacaacgctgagaggcgaggacacggctagtntattacgngtgcgagacgatcgaactagtacgaacgtaacgggtaaattcgttttaggacttaccgtacggtacgggggaccgaaaggggacctaacggttcggtaccctaacccggttctccgttaaccgaacgccccgttacccgaaaccgtaaaccggggccccttaacggttcccggttcccccgtttcccccggcggggtccccttcccccgtacggccccgtttaaccgaacggggtaaccccg

SEQ ID NO: 386219 - DNA, 672 bp, Homo sapiens
  misc_feature: GZ8MTXP01AX06K.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggatcacttcagtgctatggcatgcacgtggcctccgccgaggccgtccggggcgaagggggctggggaggtggggtgacctaatttagtagtggtatagaagtaaggtaaagtaaataaagcgttagtggtacggtaccttaccgggtagaacggggtaccgtattacccgaacctacttccgtaccgaacgaacgaacccaaacctaccgaaaacgtaaacccgtacttaccgtttacgttttaacctaacccgtaaaattacggaaacctaacggtcccgttaaggggaacggtaacggggaccggaaacgggaaccgaccggggtacttaaggttacggttaatttaaccggttgggttacggaacggaaggtaagacgttccgaacgtaagttaacgggtaaaccggg

SEQ ID NO: 386220 - DNA, 676 bp, Homo sapiens
  misc_feature: GZ8MTXP01BITA6.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggcgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaataaagactatggtggacgtccgtagaagggccgtattcaccatctacagacgacaactaccaaagaacactctcgtttcacaaatcgaacaacgcctgagaggacgacggacacggcagtagtattacgtgtagacgagaagatacgacagtacgaacgtaacggggtaaagttaccggtttttgaacgttccgttaccgggtaggggaaccccgtaaaggggacctaaaccggttcgggtacccgttaacccggttccttccgtttaaccgacccgttaccccgttaccccgaaacccggtaaaccggggccccttaacggtttcccccgggttccccgtttccccccccgtcggggccccgttcccccgttcggaccccgttaacccgaacgggaacccg

SEQ ID NO: 386221 - DNA, 579 bp, Homo sapiens
  misc_feature: GZ8MTXP01EF73Z.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaaagactaatgtggactccgtgaaagggccgattcaccatctccagagacaactccaagaacactctcgtttactcaaatgaacaagcctgagaggcgaggacacggcagtgtattactgtgcgagagatcgacatgaacgtacgggaaagtcgttttggatcgtcgtagggggaccaaagggggtacaacgtgggtccaaccggttctccttcaacgccctacccgaacccgaacggggccccaacgttcccgggttcccttccccccgtggcccgtccccgtcggccttcccgaacggtaaccg

SEQ ID NO: 386222 - DNA, 556 bp, Homo sapiens
  misc_feature: GZ8MTXP01A7R19.22.86.H09.1.454.CMB.2.raw
  modified_base (403)..(403): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtgcaattatatggtatgatggaaagtaataaagactatgtggactcgtgaagggccgattcacatctcagagacaactccaaagacactctgttctacaaatcgaacaagcctgagacgggcgaggacacggcagtgtattacgtgtgcgagagatcgaanagtagaacgtacggaagtcgtttagattcgtacggtcgggaccgaagggacgtacgtcgtcctaccgtctctcacgccctaccgaccgaaccggcccttacgttcccggttcccttccccgtcggtcccgcccgtcgcctccgaacggaaccg

SEQ ID NO: 386223 - DNA, 577 bp, Homo sapiens
  misc_feature: GZ8MTXP01ADA6X.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctggggaggtccctgagactctcctgtgcagcgtctggattcaccttcagtggctatggcatgcactggctccgccaggctccgggcaagggggctgggagtggggtgcaattatatggtatgatggaagtaataaagactatgtggactccgtgaaagggccgattcaccatctccagagacaactccaaagaacactctcgtttcacaaatgaacaagcctgagagggcgaggacacggcagtgtattacgtgtgcgagagatcgacatgaacgtacgggaaagtcgttttagattctcgtcgggggaccaaagggacacgtcggtcaccggtctccttcaacgccctaccaccgaaacgggccccttacgttccgggttcccttccccccgtgggccccgtccccgtcggcccttcccgaacgggtaacccg

SEQ ID NO: 386224 - DNA, 544 bp, Homo sapiens
  misc_feature: GZ8MTXP01ECZQP.22.86.H09.1.454.CMB.2.raw
  modified_base (396)..(396): a, c, t, g, unknown or other
  modified_base (517)..(517): a, c, t, g, unknown or other
  modified_base (523)..(523): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactaatggtggactccgtgaaggccgatcacatctccagagaacaactacaaagaacactctcgtttactacaaatcgaacaagcctgagaggcgaggacacgggcagtgtatactgngcgagagatcgacagtgaactaacgggaaatcgtttagatcgcgtgggaccaagggacacgtggtccacgtctctcacgccctaccaccgacgggcccacgttccggttcccttcccccgnggcccnccctgcctccgaagggaaccc

SEQ ID NO: 386225 - DNA, 530 bp, Homo sapiens
  misc_feature: GZ8MTXP01DAMIH.22.86.H09.1.454.CMB.2.raw
  modified_base (189)..(189): a, c, t, g, unknown or other
  modified_base (228)..(228): a, c, t, g, unknown or other
  modified_base (308)..(308): a, c, t, g, unknown or other
  modified_base (313)..(313): a, c, t, g, unknown or other
  modified_base (384)..(384): a, c, t, g, unknown or other
  modified_base (398)..(398): a, c, t, g, unknown or other
  modified_base (427)..(427): a, c, t, g, unknown or other
  modified_base (505)..(505): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggctccgccaggctccgggnaaggggctgggagtgggtggcaattatatggtatgatggaaataataaagactatgtgactcgtgaaggccatcacatcncaganacaactcaaagaacactctcgttacacaaatgaacagcctgagaggacgagacacggtcagtgtatactgngcgagagatacganatgaactacgggaaagtctttgatctcgngggaccaaggacacgtggtcaccgtctctcacgcctaccaccgaaacgggcccttagttccggttcccttcccccggngtcccgcccgtcgcctccgaacgcg

SEQ ID NO: 386226 - DNA, 502 bp, Homo sapiens
  misc_feature: GZ8MTXP01DY26E.22.86.H09.1.454.CMB.2.raw
  modified_base (308)..(308): a, c, t, g, unknown or other
  modified_base (334)..(334): a, c, t, g, unknown or other
  modified_base (463)..(463): a, c, t, g, unknown or other
  modified_base (475)..(475): a, c, t, g, unknown or other
  modified_base (485)..(485): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggagtccctgagactctcctgtgcagcgtctggatcaccttcagtggctatggcatgcactggctccgcaggctccgggnaaggggctggagtgggtgccaattanatggtatgatggaaataataaagctatgtgactcgtgaaggcgatcacatctccagagaacaactaccaaagaactacttcttcgtttaccaccaaatcgaaacacgcctgagaggcgaaggacacggnagtgtattacgngttagcgagngatcgatgttgtaacgg

SEQ ID NO: 386227 - DNA, 612 bp, Homo sapiens
  misc_feature: GZ8MTXP01CA3IT.22.86.H09.1.454.CMB.2.raw
  modified_base (415)..(415): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggcgtccgggcaaggggctgggagtgggtggactaattatagtggtatgaataggaaagtaaataaagactatggtggactccggtgaagggccgattcacatctccagaagacaactaccaaagaacacttcttcgtttaccacaaaatcgaaacaacgcctggaagagggcgacggacacggcagtgttattacngtgacgagaacgatcgacagtagaacgtaagggtaaagttcgtttagacgttacgtcggtacggggacccaaggggactacgtcggtcctacccgttctccgttcacggttccctacccgaccgaaaccgggtcccttacgttccgggttccccctccccgtcggcccgtcccgtcgccgtaaccggcggtaacccg

SEQ ID NO: 386228 - DNA, 586 bp, Homo sapiens
  misc_feature: GZ8MTXP01B3ODO.22.86.H09.1.454.CMB.2.raw
tcagacatacgcgtcacgaccggtgctcgatttagtgctatagacttgggtttgggctgagcgtgggttttccgtcgttagctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaagggggctgggagtggggtgcaattatatggtatgatggaaagtaataaagactatgtggactcgtgaagggccgattcaccatctaccagagacaactccaaagaacactctcgttctacaaatgaacaagcctgagaggcgaggacacgggcagtgtattacgtgtgcgagagatcgacatgaacgtaacggggtaaattcttttagaacgttctcggtacgggggacccaaagggggactacgttcgggtacctaacccggtctccttcaacgttccctcccgaaccgaacgggcccacgttccgggttccctttcccccgcgggccctcccgtcggacccctccgcgtcg

SEQ ID NO: 386229 - DNA, 569 bp, Homo sapiens
  misc_feature: GZ8MTXP01A7FF5.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgcaggctccgggcaaggggctgggagtgggtggcaattatatggtatgatggaagtaataaagactatgtggactccgtgaagggccgattcaccatctccagagacaactccaagacactctcgttctcaaatgaacaagcctgagaggcgaggacacggcagtgtatactgtgcgagagatcgacatgaactaacgggaagcgttttggaattcgtacgtggggacccaaggggactaacgtcgggtcctaccgttctcgttaacacggttccctaccacccgaaacggggccccacgttccgggttcccttcccccgtggcccgtccctcggttcctcccgaagggaacccg

SEQ ID NO: 386230 - DNA, 615 bp, Homo sapiens
  misc_feature: GZ8MTXP01DSOA7.22.86.H09.1.454.CMB.2.raw
  modified_base (229)..(229): a, c, t, g, unknown or other
  modified_base (300)..(300): a, c, t, g, unknown or other
tcagacatacgcgtcacgaccggtgctcgatttagtgctatagacttgggtttggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcagtcaccatctcctacactggaaccngcagtgacgttggtgttacagtatgtctctggaccaacaccaccaggcacacgccccaaatcatgatttangagtcactaagcggcctcgacggggtccctgactccgcttctcgtcggcctaccgaagtctggccgaccgaccggccctcccgtcgacccgtctcgtcgggcctaccgaggctaggacgggtatggacggcttaggtaatttacgttaacgtcgtccttaactacattaagtcgacaagggccgtactaaacgttcgttgggggtcggttcgggcgggacgggaaccgtaaaggtccgttcggttacccggttacccggtaaggtcccgaacggaccccgaacggggttcctcccgggttcccccgttaaccggg

SEQ ID NO: 386231 - DNA, 614 bp, Homo sapiens
  misc_feature: GZ8MTXP01BEE5N.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaagggggctgggagtggggtgcaattatatggtaatgatggaaagtaataaagactatgtggactcgtagaaagggcattcacatctccagacgacaactccaaagaacactcttacgtttacctacaaaatcaaactagaccctggaagacgggacgagggaaccacgggctaagtagtattacgtgtcgacgagagatcgaacagagaactaacggggtaaatcggttttagaagttccgtacggtacggggacccaagggggacctaacgtcggtaccctaaccggttcctccttccgacgttccctacccgaccgtaaacgggccccttacgttccggttccctcccccgttgggccctcccgtgcccgtccgaagggtaacccg

SEQ ID NO: 386232 - DNA, 529 bp, Homo sapiens
  misc_feature: GZ8MTXP01EG77D.22.86.H09.1.454.CMB.2.raw
  modified_base (399)..(399): a, c, t, g, unknown or other
  modified_base (475)..(475): a, c, t, g, unknown or other
  modified_base (515)..(515): a, c, t, g, unknown or other
  modified_base (519)..(519): a, c, t, g, unknown or other
  modified_base (521)..(521): a, c, t, g, unknown or other
  modified_base (528)..(528): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtcactgagactctcctgtgcagcgtctggattcaccttcagtggctatggcatgcactggctccgccaggctccgggcaaggggctggagtgggtggcaaattatatggtatgataggaaagtaataaagactatgtggactcgtgaagggccgattcaccatctccagagacaaactccaaagaacactcctagtttacaccaaatgaaaaccagcctgagaggcgaggacacgggtcagtgtattacgngtgcgaagagatcgacatgaactaacgggaaaggtcttttgatcgtctggggccaaaggggacactggtcaccgtntcttcagccttcaccgaaggcccattccggtcttccccgngccncnctcgcgng

SEQ ID NO: 386233 - DNA, 508 bp, Homo sapiens
  misc_feature: GZ8MTXP01EGHMH.22.86.H09.1.454.CMB.2.raw
  modified_base (306)..(306): a, c, t, g, unknown or other
  modified_base (336)..(336): a, c, t, g, unknown or other
  modified_base (397)..(397): a, c, t, g, unknown or other
  modified_base (454)..(454): a, c, t, g, unknown or other
  modified_base (492)..(492): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcacttcagtggctatggcatgcactggctccgcaggctccgggnaagggggctggagtggggtggccaagttanagtggtatgatggtaaataaataaggactagtggtgactcgtagaacggacgatcacatcncagagacaactacaagaacactcttgttctaccaaatcgaacagcctggagacgggngaagggtacacgggcagtgtaacttagttgttgcgagngatcgatgttgaacgg

SEQ ID NO: 386234 - DNA, 553 bp, Homo sapiens
  misc_feature: GZ8MTXP01C9ZZ5.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtggggggaggcgtggtccaggcctggggaggtccctgagactctcctgtgcagcgtctggatcaccttcagtggctatggcatgcactggcctccgccagggcctccggggcagggggctgggaggtggggtggccaagtttatagtggtatggatggggaaataaacgtaaagactagtggtggactcgtgaagggcgattcacactcccagacgacaactccaaagacactctgtttcctaccaaatcgaacacgacctggacgaggcggacggaacgacggcgagttgtaacttacgttggttcgcgaaggataacgtccggacttagtcgaacgttaacgggg

SEQ ID NO: 386235 - DNA, 602 bp, Homo sapiens
  misc_feature: GZ8MTXP01DT53N.22.86.H09.1.454.CMB.2.raw
  modified_base (240)..(240): a, c, t, g, unknown or other
  modified_base (351)..(351): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaanagcacccaggcaaagccccagactcatcatttatgctgtcaataagcggccctcgaggggtccctgatcgctttctctggctcaagtctggcaacacggcctccctgaccntctctgggctccaggctgaagatgaggctgattatactgctgctctaatttcgcgtaacggccgtcctaaacgtcgtttggggtcgtttcggggacggacggggtacccaaagccgttggaaccccggttcccgttaaagggggtcccaaacgggtacccccgaaaggggcccttccgggttccccccccgttcggggtccctaacccgtttccgttcccgttcccccggtccccgtttaaccctccccgg

SEQ ID NO: 386236 - DNA, 549 bp, Homo sapiens
  misc_feature: GZ8MTXP01EG4JK.22.86.H09.1.454.CMB.2.raw
  modified_base (486)..(486): a, c, t, g, unknown or other
  modified_base (525)..(525): a, c, t, g, unknown or other
  modified_base (534)..(534): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtgacaattatatggtatgataggaagtaaataaagactatgtgactcgtgaaggccgattcaccatctccagacgaacaactaccaaagaacactctcgtttactacaaatcgaacaagcctgagagcgagacacggcagtgtatacgtgtgacgagagatacgacagtagaacgtaagggaaatcgttttagatcgtcgtgggggaccaaaggggacacgtggtccaccgtctcttcacnccctaccaccgaacgggcccagttccgttccctccccgngcccgcccngccctcgaacggccg

SEQ ID NO: 386237 - DNA, 612 bp, Homo sapiens
  misc_feature: GZ8MTXP01BB449.22.86.H09.1.454.CMB.2.raw
  modified_base (391)..(391): a, c, t, g, unknown or other
  modified_base (412)..(412): a, c, t, g, unknown or other
  modified_base (573)..(573): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctcgggcaagggggctgggagtgggtggctaattatatggtatgatggaaagtaaataaagactatgtggactcgtgaagggccgattcacatctccagacgacaactccaaagaacactcttcgtttacctacaaatcgaaacaagcctgagaggcgagacacggcagtntatactgtgcgagagatcganatagaacgtaacggggtaaatcgttttagattctcggtaggggacccaaaggggacctaacgtcgggtacctacccggtcttccttcaaccgttccccgtaccgaaaccccggaaacggggtccccttacggtttcccgggttaccccctttccccccggnggggtcccctccccgttgcccttcccgaacgggaacccg

SEQ ID NO: 386238 - DNA, 555 bp, Homo sapiens
  misc_feature: GZ8MTXP01A8TY0.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtggggtggcaattatatggtatgatggaagtaaataaagactaatgtggactccgtgaaagggccgattcaccatctccagagacaactccaaagaacactctcgtttctacaaatgaacaagcctgagaggcgaggacacggcagtgtattactgtgcgagagatcgacatagactaacgggaaagtcgttttagatcgtcgtggggcccaaggggcaacgtcggtccaccgttcctcttaacgcccttaccaccacgggcccagttccggttcccttccccgtcgccgccctcgccttcccgaaggcgaaccc

SEQ ID NO: 386239 - DNA, 616 bp, Homo sapiens
  misc_feature: GZ8MTXP01DBWMH.22.86.H09.1.454.CMB.2.raw
  modified_base (385)..(385): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaagggggctgggagtggggtggcaattatatggtatgatggaagtaaataaagactatgtggactccgtgaagggccgattcaccatctccagacgacaactccaaagacactctcgttcacaaatgaacaagcctgagaggacgagacacggcagtntatactgtgcgaagagatcggaacagtagaacgtaacgggaaaagtcgttttagaacttcgtcgtagggggaccctaaagggggactaacgttcggtacctaacccggttcttccgtttaaccaacggttcccttacccgaaaccgtaaaccggggccccttaagttcccgggttcccctttccccccgtgggcccgtccccgtggttcccttaacccgaagggtaacccg

SEQ ID NO: 386240 - DNA, 584 bp, Homo sapiens
  misc_feature: GZ8MTXP01B6GAL.22.86.H09.1.454.CMB.2.raw
  modified_base (256)..(256): a, c, t, g, unknown or other
  modified_base (559)..(559): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggctccgggcgaaggggctggagtgggtgctaattantggtatgatggaaagtaataaagactaagtgtggaactccggtagaagggccgattcaccatcctaccagaacgaacaaactaccaaagaacactcttcgtttaccacaaatgaacaagccctgagaggcgaaggacacggacagtgtattacgtgtgagagagatcgaacagtagaacgtaaacgggaaagttcgtttagacgtcgttacggacggggaccaaagggggacctaacgtcggtcctaccgttcctcttcgacgttcccacacgaaccggtcccacgttcgcccctttccccgngcccgtccgcgttaccctcgaacgc

SEQ ID NO: 386241 - DNA, 610 bp, Homo sapiens
  misc_feature: GZ8MTXP01D1IDZ.22.86.H09.1.454.CMB.2.raw
  modified_base (176)..(176): a, c, t, g, unknown or other
  modified_base (588)..(588): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagctgggtggagtcgtgggggaggcgtggtccagccgtgggacgtccctgagctctctgtgcagcgtctggattcaccttcagtggctagtggcatgcacgtcggcctccgccgacgggccgtccggggacgaagggggcgtgggaggtggggtcgactaaagttagtagtggtatggagtaaggtaaaaattaaataaggacttagtggtacggacgtaccgggaggaaacgggccgtattaccaacctagtcctacgaaagacgaaacaaacctaccaaaacaacctacttaccttacggtttaccaacctaaaagtacgaaacaggtccaggaacgaggacgaggacgacggaactagttgtagttacgtgtgacgttagataatcgaanagtagaacgtaacggaagttcg

SEQ ID NO: 386242 - DNA, 576 bp, Homo sapiens
  misc_feature: GZ8MTXP01C8CFU.22.86.H09.1.454.CMB.2.raw
  modified_base (189)..(189): a, c, t, g, unknown or other
  modified_base (381)..(381): a, c, t, g, unknown or other
  modified_base (389)..(389): a, c, t, g, unknown or other
  modified_base (391)..(391): a, c, t, g, unknown or other
  modified_base (398)..(398): a, c, t, g, unknown or other
  modified_base (404)..(404): a, c, t, g, unknown or other
tcagacatacgcgtcacgaccggtgctcgatttagtgctatagacttgggtttgggctgagctgggtttcctcgttgctcttttaagaggtgtccagtgtcaggtgcagctggtggagtcgtggggggaggcgtggtccagcctgggaggtccctgagactctcctgtgcagcgtctggattcaccttnagtggctatggcatgcactggctccgccaggctccgggcaaggggctgggagtgggtgacaattatatggtatgataggaagtaaataaagactatgtggactcgtgaaggccatcaccatctcagagacaactacaaagaacactctcgtttacacaaatgaacaagcctgagagcgagacaggtcaggtntattacgngngagaganacacanagagacgtaagtaagtagttagtagtacgtacgtacggacgaacggacgtacgtcgtccgtaccgtcctctctaccgttacccgtacccgacccgaaccggtacccgttaccgttcccgttccccgttccccgtcccggtcccgtcccgtccgttccgtccgaacggaaccg

SEQ ID NO: 386243 - DNA, 520 bp, Homo sapiens
  misc_feature: GZ8MTXP01CD5JA.22.86.H09.1.454.CMB.2.raw
tcagacatacgcgtcacgaccggtgctcgatttagtgctatagacttgggtttgggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtggctatggcatgcactggctccgccaggctcgggcaaggggctggagtgggtggcaattaatatggtatgataggaagtaataaagactatgtaggactccgtagaagggcgtattcaccatctccagacgacaactaccaaagaacactctgttctaccaaatgaacagcctgagaggacgaggaacgacggacgagttagtaattacgtgtgcgagtaagaataacg

SEQ ID NO: 386244 - DNA, 552 bp, Homo sapiens
  misc_feature: GZ8MTXP01DR70M.22.86.H09.1.454.CMB.2.raw
  modified_base (269)..(269): a, c, t, g, unknown or other
  modified_base (479)..(479): a, c, t, g, unknown or other
  modified_base (488)..(488): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagcctgggagtccctgagctctcctgtgcagcgtctggatcaccttnagtggctatggcatgcactggcctccgcaggcctccgaggcgaagggggctgggagtggggtcgactaaatttagtaagttgggtaaatggaagtagggaaaagttaaataaacgactaagtggtaggactcggtaggaacgggccattcacatctaccagacgaacaactaccaaaggaactacttcttagttaccaccaaatgaaacngcctagagnggaacgaggacgacggcgagttgttaagttcttggtgacggaagaagattacgaacaagtaacg

SEQ ID NO: 386245 - DNA, 557 bp, Homo sapiens
  misc_feature: GZ8MTXP01CIQXV.22.86.H09.1.454.CMB.2.raw
  modified_base (239)..(239): a, c, t, g, unknown or other
  modified_base (261)..(261): a, c, t, g, unknown or other
  modified_base (271)..(271): a, c, t, g, unknown or other
  modified_base (354)..(354): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaangcaccagcaaacgccccagacncatcatttangctgtcaataagccggccctcgacgggggtccctgactcgctttctcgtggctcaagtctcggcaacgcgcctccctgacccntctctgggctccgaggctagaagatgaggctgtattattactgctgctcatttgcgtaggccgtcctacgtacgttgggtcggttcgggcgggacgggaccaaggtcctcggaacccgtcgttacggtccgacgcccgaaggcccgttccgttcccccgtcgggtacctccgttccttccgttacccctcccttcccgtcccg

SEQ ID NO: 386246 - DNA, 514 bp, Homo sapiens
  misc_feature: GZ8MTXP01DU1RN.22.86.H09.1.454.CMB.2.raw
  modified_base (310)..(310): a, c, t, g, unknown or other
  modified_base (367)..(367): a, c, t, g, unknown or other
  modified_base (418)..(418): a, c, t, g, unknown or other
  modified_base (467)..(467): a, c, t, g, unknown or other
  modified_base (493)..(493): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtctggggggagcgtggtccagcctgggaggtccctgagactctcctgtgcagcgtctggatcaccttcagtggctatggcatgcactggcctccgcaggctccgggnaagggggctggagtgggtggccaagttatagtggtatgatggaaataataaagctangtgactcgtgaaggccgattcacatctcagacgacaactacaagaacactntcgttactaccaaatgaactagcctaggagacggcgaacgggcacgggnaggtgtattacgttgttaggcgaagngagtcgactaagttgtaacgg

SEQ ID NO: 386247 - DNA, 656 bp, Homo sapiens
  misc_feature: GZ8MTXP01DKFR3.22.86.H09.1.454.CMB.2.raw
  modified_base (227)..(227): a, c, t, g, unknown or other
  modified_base (255)..(255): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgcaggctccgggnaaggggctgggagtggggtggcaattanatggtatgatggaaagtaataaagactatgtggactcgtgaaggcgattcaccatctccagacgaacaacctccaaagaacactcttcgtttctaccgaaatcgaaacacgacctgagagggcgaggacacggctagtgtattactgtgcgaggagatacgacatacgaacgtaaacggggtaaagttcgtttttaggacttccggttacggtacgggggtacccgaaggggtaaccgtaacgttcgggtccgttaacccgtcgttcctttaacgaaccgttccccttaccccgaaaccgtaaaccggggtccccttaacggttcccgggttccccgttttcccccggcgggtccccgttcccccgtcggttcccgttaaccccggaacgggtaaccccgg

SEQ ID NO: 386248 - DNA, 520 bp, Homo sapiens
  misc_feature: GZ8MTXP01EY8JM.22.86.H09.1.454.CMB.2.raw
  modified_base (306)..(306): a, c, t, g, unknown or other
  modified_base (394)..(394): a, c, t, g, unknown or other
  modified_base (489)..(489): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcacttcagtgctatggcatgcactggctccgccaggctccgggnaagggggctgggagtggggtgccaattatagtggtatgatggaaataaataaagctagtgtgactcgtgaggccatcacatctcaganacaactacaagaacactcttagttcaccgaaatcgaacacgacctgaagagggacgaaggaacgcggacttagtcgttaagttacgttgttacgngaagaagacgtcgacgtaagttcgtaaccgg

SEQ ID NO: 386249 - DNA, 638 bp, Homo sapiens
  misc_feature: GZ8MTXP01DEXZ5.22.86.H09.1.454.CMB.2.raw
  modified_base (610)..(610): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggcaaggggctgggaggtgggtggcaattatatggtatgataggaaagtaaataaagactaagtggtaggactccggtaggaaagggccgaattccaacctatcctacccagaagaaccaactaccaaagaactactcttacgtttacctacaaaatcgaaacaacgcctggaaggacgggacgaacgggaaccgacgggctaaggtagttaattacgtggtagacggaagaagacgtacgacaagtacgaaacgtaacggggaaattcgttttgtaacgttcgtacggtacggggacccaaaggggacctacgtcggtaccacccgttctccttcacgttccctaccgaccgaacgggcccttacgttcccgttcccttcccccgngtcccgccctcgccctccgcggaacccg

SEQ ID NO: 386250 - DNA, 562 bp, Homo sapiens
  misc_feature: GZ8MTXP01B54BJ.22.86.H09.1.454.CMB.2.raw
  modified_base (487)..(487): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaaataaagactatgtggactccgtgaagggccgattcaccatctccagacgacaactaccaagaacactctcgtttacacaaatgaacaagcctgagaggcgaggacacgggcagtgtattacgtgtgcgagagatcgacagtagaacgtaacggggaaagtcgttttagattcgtacgtcggggaccaagggcacgtggtccaccgtctcttcncgttccctaccaccgaacgggcccacgttccggttcccttccccgtggcccgtcccgtgcctccgaaggaacccg

SEQ ID NO: 386251 - DNA, 492 bp, Homo sapiens
  misc_feature: GZ8MTXP01ARJ9G.22.86.H09.1.454.CMB.2.raw
  modified_base (304)..(304): a, c, t, g, unknown or other
  modified_base (328)..(328): a, c, t, g, unknown or other
  modified_base (349)..(349): a, c, t, g, unknown or other
  modified_base (391)..(391): a, c, t, g, unknown or other
  modified_base (403)..(403): a, c, t, g, unknown or other
  modified_base (406)..(406): a, c, t, g, unknown or other
  modified_base (421)..(421): a, c, t, g, unknown or other
  modified_base (446)..(446): a, c, t, g, unknown or other
  modified_base (448)..(448): a, c, t, g, unknown or other
  modified_base (452)..(452): a, c, t, g, unknown or other
  modified_base (459)..(459): a, c, t, g, unknown or other
  modified_base (474)..(474): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtcctgagactctcctgtgcagcgtctggatcacttcagtggctatggcatgcactggctccgcaggctcgggnagggggctggagtggtgccaattnagtggtatgatgggaaataanaaagctatggtgactcgtgaagggccgattcacatctcaganacaactccaaanacnctcttcttacacaangaacacgctgacgaggcgaaggacngnagtntattcgngcgaacgagaacganacgactaacgttgtaacg

SEQ ID NO: 386252 - DNA, 613 bp, Homo sapiens
  misc_feature: GZ8MTXP01CGAU6.22.86.H09.1.454.CMB.2.raw
  modified_base (333)..(333): a, c, t, g, unknown or other
  modified_base (345)..(345): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtggggacggtccctggagactctcctgtgcagcgtctggatcacttcagtgctatggcatgcactggcctccgcaggctccgggcgagggggctgggaggtggggngtaccaaagttntagtgggtatagaagttgggaaagttaaactaaaggtactaagttggtagggaccgtacccggtaggaacgggccgtattaccaacctatcctaccaaggacaacctaaacctaccaaacgaaaccgtacttcttacgttactaaccctaaatcgaaacacgaccctggaaggacggacggaacggaaccgacgggaccttaggttagttacgtttaacgttggagaacggagaacgtagtaccggactaagttaacggtaaaccggg

SEQ ID NO: 386253 - DNA, 561 bp, Homo sapiens
  misc_feature: GZ8MTXP01BR8EE.22.86.H09.1.454.CMB.2.raw
  modified_base (192)..(192): a, c, t, g, unknown or other
  modified_base (231)..(231): a, c, t, g, unknown or other
  modified_base (252)..(252): a, c, t, g, unknown or other
  modified_base (258)..(258): a, c, t, g, unknown or other
  modified_base (294)..(294): a, c, t, g, unknown or other
  modified_base (315)..(315): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (344)..(344): a, c, t, g, unknown or other
  modified_base (346)..(346): a, c, t, g, unknown or other
  modified_base (348)..(348): a, c, t, g, unknown or other
  modified_base (351)..(351): a, c, t, g, unknown or other
  modified_base (353)..(353): a, c, t, g, unknown or other
  modified_base (384)..(384): a, c, t, g, unknown or other
  modified_base (393)..(393): a, c, t, g, unknown or other
tcagacatacgcgtcacgaccggtgctcgatttagtgctatagacttgggtttgggctgagcgtgggttttcctcgttagctcttttaagaggtgtccagtgtcaggtgcagctggtggagtcgtggggggaggcgtggtccagcctgggaggtccctgagactctcctgtgcagcgtctggattcaccttnagtggctatggcatgcactggctccgccaggctccgggnaaggggctgggagtgggtganaattanatggtatgatggaataataaagactatgtgactcgngaaggcatcaccatctcaganacaactccaaanacnctntcttacacaanananaancngagagacgagacgacgagagtagtatagtgngagagaganacgacagagaacgtaagtaagtagttagtagtcgtacggtacgggacgaacggacgtacgtacgtcgtaccgtctctccaccgacctacccgaaccgaaccggtaccgttaccgttcccgttcccgttccccgtccgcccgtcccgtccgaccgtaaccgaacgaacg

SEQ ID NO: 386254 - DNA, 640 bp, Homo sapiens
  misc_feature: GZ8MTXP01EB151.22.86.H09.1.454.CMB.2.raw
  modified_base (414)..(414): a, c, t, g, unknown or other
  modified_base (426)..(426): a, c, t, g, unknown or other
  modified_base (442)..(442): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtcggcctccgccgaggccgtccgggacgaagggggctgggaggtgggtgactaatttatagtggtatgaataggaaagtaaataaagactatggtggactcgtagaaggcctattacacatctaccagacgaacaactaccaaagaactactcttaccgtttacaccaaatacgaacaacgctggagaggcgaagacacggcagtntattacgtgggngacgagagtatacganagtacgaacgtaagggtattcgtttagacgtcgtacggacgggaccgtaaggactacgtcgtaccgtaccgttcctcgtaaccgccgttaccccgtaacccgaaaccggtaacccggtaccccgttacgttccccggttcccccgttcccccggcggtccccgtcccgtaccgacccgtaacccggaacggtaacccg

SEQ ID NO: 386255 - DNA, 598 bp, Homo sapiens
  misc_feature: GZ8MTXP01AR6AS.22.86.H09.1.454.CMB.2.raw
  modified_base (370)..(370): a, c, t, g, unknown or other
  modified_base (387)..(387): a, c, t, g, unknown or other
  modified_base (401)..(401): a, c, t, g, unknown or other
tcagacatacgcgtcacgaccggtgctcgatttagtgctatagacttgggtttgggctgagcgtggtttcgtcgttagctctttaagaggtgtccagtgtcaggtgcagctggtggagtctggggggaggcgtggtccagcctggggaggtccctgagactctcctgtgcagcgtctggattcaccttcagtggctatggcatgcactggctccgccaggctccggggcaagggggctgggagtgggtgcaattatatggtatgatggaagtaataaagactatgtggactccgtgaaagggccgattcaccatctccagagacaactccaagaaccactctcgttctacaaatcgaacaagccctgagngggcgagggacacgggntagtgttattacgnggtgagagagacgtacgacgagtacgtaacggtaacgggtaacgttacggtttacgtagtacgtacggtacgggacggaacggacgtacgtacgtccgtaccgtccgtctcgtcgcctacccgaccgaaccggtacccgttaccgttcccggttcccgttccccgtcccggtcccgtcccgtccgccgtccgcgccg

SEQ ID NO: 386256 - DNA, 698 bp, Homo sapiens
  misc_feature: GZ8MTXP01APW3G.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctgatcaccttcagtgctatggcatgcacgtggcctccgccgagggccgtccgggacgaagggggctaggggagtggggtgacctaaagttgtaaagttgggtaataggtaagttaagggaaaagttaaaacgtaaaaggtacttagttgggtacgggtaacccgttaccggttagggaaacggggcccgtaagtttacccgaaccctacgttcctacccgaaggaaccgaaaccctaaacctacccgaaaacgtaaacccgtaacctttaccgtttacgtttaacccctaaccctaaaacgttacggaaaacctacggtacccgttagggaaacgggacgggaacggaacgggaaccgacggggtaccttaaggttacgttaagtttccgttggttacggaacgtaaggaagtacgtacgacgtaagttaacggtaaacggg

SEQ ID NO: 386257 - DNA, 564 bp, Homo sapiens
  misc_feature: GZ8MTXP01AOYXL.22.86.H09.1.454.CMB.2.raw
  modified_base (390)..(390): a, c, t, g, unknown or other
  modified_base (556)..(556): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaataataaagactatgtggactccgtgaagggccgattcaccatctccagagacaactcaaagaacactctgtttcacaaatgaacaagccctgagacgggacgagggtacacgggcaggtntattactgtgcgagagatcgacatgaactacgggaaagtcgtttgattctacgtggggccaagggacacgtcggtctaccgtctcttcaacggttcctacccaccgaaacgggcccacgttccggttcccttccccccgtggcccgtccccgttggcccttcccgnggaacccg

SEQ ID NO: 386258 - DNA, 552 bp, Homo sapiens
  misc_feature: GZ8MTXP01AGQIF.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaagggggctgggagtggggtggcaattatatggtatgatggaagtaataaagactatgtggactccgtgaagggcgattcaccatctccagagacaactccaagaacactctcgtttctacaaatgaacaagcctgagagggcgaggacacgggcagtgtattacgtgtgcgagagatcgacagtagacgtacggaaagtcgttttgatctcgtaggggccgaagggacacgtggtcctaccgtctcgttcacgttccctaccgaccgaacgggcccagttccggttccctcccccgtggcccgccctcgcctccgcggaaccg

SEQ ID NO: 386259 - DNA, 611 bp, Homo sapiens
  misc_feature: GZ8MTXP01CRC0U.22.86.H09.1.454.CMB.2.raw
  modified_base (398)..(398): a, c, t, g, unknown or other
  modified_base (413)..(413): a, c, t, g, unknown or other
tcagacatacgcgtcacgaccggtgctcgatttagtgctatagacttgggtttgggctgagctgggttttcctcgttgctcttttaagaagtgtccagtgtcaggttcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtaggactccggtagaagggccgattcaccatcctcagagacaactccaaagaacactctgtttcccaccaaatgaaacagacctgaagaggcgaggacacggcagtgtattacgngtgcgagagatcganagtgaacgtaacgggaaatcttttaggacttcgtcgtacgggggaccaaaggggacctaacgtcgggtacctacccggtctccgttcgaacgtccccttaccgaaacccgaaacggggtcccctaacgttcccgggttccccttcccccgtcggggcccctccccgtcgtcccgttacccgaacgggccgtaaccccg

SEQ ID NO: 386260 - DNA, 570 bp, Homo sapiens
  misc_feature: GZ8MTXP01BU4AJ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaataaagactatgtggactccgtgaagggccgatcacatctccagagacaactaccaagaacactctcgtttacctacaaatcgaacaacgcctgagaggcgaggacacggcagtgtatactgtgcgagagatcgacagtagaacgtaacgggaaagtcgtttttagaattcctacggtcgggggaccaaaggggactaacgtggtcctaccggtctcttcacgttccctaccgaccgtaaacgggcccagttccggttccttcccccgggcccgccctggcctccgaagggaaccc

SEQ ID NO: 386261 - DNA, 499 bp, Homo sapiens
  misc_feature: GZ8MTXP01AS5MT.22.86.H09.1.454.CMB.2.raw
  modified_base (424)..(424): a, c, t, g, unknown or other
  modified_base (463)..(463): a, c, t, g, unknown or other
  modified_base (475)..(475): a, c, t, g, unknown or other
  modified_base (480)..(480): a, c, t, g, unknown or other
  modified_base (484)..(484): a, c, t, g, unknown or other
  modified_base (494)..(494): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccagcctgggaggtccctgagactctcctgtgcagcgtctggatcaccttcagtggctatggcatgcactggctccgcaggctccggggcaagggggctgggagtggggtggccaattatatggtatgatggaaagtaaataaagactatgtgactccgtagaaggccgattcacatctcagagacaactccaagacactctnttacaccaaatgaacagcctgagaggcgaaggcacgggnagtgtattacgngttgngagngatcgaatgngaacg

SEQ ID NO: 386262 - DNA, 602 bp, Homo sapiens
  misc_feature: GZ8MTXP01D5VOM.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagctggtggagtcgtgggggagcgtggtccagccgtggggagtccctgagctctcctgtgcaggcgtctggacttccaccttcagtggctagtggcatcgcacgtggcctcccgcgaggccgtccgggcgaagggggctgggaggtggggtgactaattaatagtgggtaatggaagtaggaaagttaaataaagtactaatagtaggactccggtaggaacgggtaccgtattaccacctactcctaccgaagacgaaccgaaactaccgaaacgaacctacttcttcgtttacctaacctaaatacgaaacacgccgtaaggaacggaggacgaggacgacggacgttagttagttaattacgtgtggacgagaagttaagtaacg

SEQ ID NO: 386263 - DNA, 516 bp, Homo sapiens
  misc_feature: GZ8MTXP01ANO07.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggatcacttcagtggctatggcatgcactggctccgcaggctccgggcaagggggctgggagtggggtggccaagttatagtggtatagatgggaaagtaaataaagactagtggtggacctccggtagaacgggcgattcacatctccagacgacaactccaagaacactctgttacaccaaatgaacagcctgagaggcgaaggacacggcagtgtaattcgttgttgcgagaagatcgactaagttcgaacg

SEQ ID NO: 386264 - DNA, 611 bp, Homo sapiens
  misc_feature: GZ8MTXP01DE0VW.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggacgtccctgagactctcctgtgcagcgtctggatcacttcagtggctagtggcatgcacgtcgggcctccccggccgaggccgtcccgggggacaaggggggctgggggaggtggggtacggacctaaatttagtagtggtataggagtaagggaaataaataaagctagtcggttacggaccttccggtagaacgggccgtacttcaccaatcctaccaaggaacaccaaactaccgaaagtaacctacttcttacgtttactaacccgaaattcgaaacgtacgccgtagaaggacgggcgaagggaccacgggagttagttacgtattacgttggttacgcggaagtaagacgtaccgagtaacgttaaggaaaccgg

SEQ ID NO: 386265 - DNA, 518 bp, Homo sapiens
  misc_feature: GZ8MTXP01AJA5P.22.86.H09.1.454.CMB.2.raw
  modified_base (227)..(227): a, c, t, g, unknown or other
  modified_base (341)..(341): a, c, t, g, unknown or other
  modified_base (415)..(415): a, c, t, g, unknown or other
  modified_base (497)..(497): a, c, t, g, unknown or other
  modified_base (512)..(512): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctcgccaggctccgggnaaggggctggagtgggtgcaattatatggtatgatggaagtaataaagactatgtggactccgtgaagggccgattcacatctccagagacaactccaagaacactctgtttcncaaatgaacaagcctgagaggcgaggacacggcagtgtattactgtgcgagagatcgacatgactacgggaaancgttttgatctcgtggggccaagggcacgtggtcaccgtctcttcagcctccacgaagggcccagttcggttccttccccgngccgccctgctccgngaaccg

SEQ ID NO: 386266 - DNA, 685 bp, Homo sapiens
  misc_feature: GZ8MTXP01DZ409.22.86.H09.1.454.CMB.2.raw
  modified_base (276)..(276): a, c, t, g, unknown or other
  modified_base (319)..(319): a, c, t, g, unknown or other
  modified_base (575)..(575): a, c, t, g, unknown or other
  modified_base (638)..(638): a, c, t, g, unknown or other
  modified_base (664)..(664): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggttgtccagtgtcaggtgcagctgggtggagtcgtgggggagcgtggtccagccgtgggacgtccctgacgtactctccngtagcagcgtctggactttccacctttcgaggttggcttaagnggcagtcgacctacgtcggcctcccgccgacgggtccgtcccggggagaagggggtcttgggacggttggggtagacttaaagtttaaagaaggttggtaataggggaaacttaagggaaaagttaaacgtaaaagtgttaagttacgggtacggtaaccgttaccgggtagggaaaacccggggtcccttaagtttacccaaccgtattaccgaccgaaagtaccgaacgtaaaaccctcgaaaacgtaaacctntccgtttaagtttaccaaacctaaagtcgaaacgtcgacgaagaacggacggccgaaaggacncgggttattgttacgttaattacggngagacgataacgaacgtaacg

SEQ ID NO: 386267 - DNA, 561 bp, Homo sapiens
  misc_feature: GZ8MTXP01D8SD6.22.86.H09.1.454.CMB.2.raw
  modified_base (319)..(319): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctggggagtccctgagactctcctgtgcagcgtctggatcaccttcagtggctagtggcatgcacgtggcctccggccagggcctcccggggnaagggggctgggagtggggtgacctaattatagtggtatagatgggaaataaataaaggacttagtggtaggaccgttccgtaggaacgggccgtattccaacctatcctaccagaacgaacaaactaccaaagaactacttcttagtttacctaccaaatcgaaacacgcctaggagaggcgaaggacacgggcagtgtaattacgttggttagcgagaagatacgactaagttgaaccgg

SEQ ID NO: 386268 - DNA, 701 bp, Homo sapiens
  misc_feature: GZ8MTXP01C6H2U.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagctggtggagtcggtgggggaggcgtggtccaggccgtggggacggtccctggacgactctccgtgtgcaggcgtctggacttccaccttcgaggtggctagtggctatcggcacgtcggccctcccggccgacgggccgtccgggggacgaaacgggggcttacgggggagggttggggtacggtactaaagtttaaagtaggttggtaatagggtaaagtaaggggtaaaacgttaaagtaaaagtacttagttggtacgggtaaccgttccgggtaagggaaacggggtacctacttaccaacctattacccgaacgaagtaacgaaaccgtaaacctaaccggaaactaacctaccgttcttaacgtttcctaaacctaaagtaccgaaacgacgtccgtaaggacggagggaccgttaaggaaccgtacggacgttaggttacgttaatacgttggaggacgaggtaacgttaagtaaccg

SEQ ID NO: 386269 - DNA, 574 bp, Homo sapiens
  misc_feature: GZ8MTXP01B1VHC.22.86.H09.1.454.CMB.2.raw
  modified_base (254)..(254): a, c, t, g, unknown or other
  modified_base (407)..(407): a, c, t, g, unknown or other
  modified_base (542)..(542): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtggcaattanatggtatgatggaagtaaataaagactatgtggactccgtgaaagggccgattcaccatctccagagacaactccaagaacactctcgtttcacaaatcgaaacagcctgagaggcgagacacgggcagtgtatactgtgcgagagatcgaanatagaacgtacgggaaatcgttttaggaattccgtacgtcgggggaccaaaggggccaacgtgggtccaccggtctcgttcacgttccctaccaccgtaaacgggccccacgttccgggttccctttcccccggngggcccgccccttggcctcccgaaggaacccg

SEQ ID NO: 386270 - DNA, 685 bp, Homo sapiens
  misc_feature: GZ8MTXP01C6R9T.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggatcacttcagtggctatggcatgcacgtggcctccgcgaggccgtccggggacgaagggggctagggaggtggggtggacctaaagtttagtagtaggtataggaagtgggtaaaataaagtaaagtacgttagtgggtacgggaaccgtaccggtaggaacgggtcccgtaattaccgacccaagttccgtacccgaagaacgaacctaaaccgtaacccgaaacgtaaacctaaccgtttaccttacggttttaaccctaaccctaaaagttacggaaaccgtaacggtacccgttaggaacgggtaacgggaccggaaacgggtaaccgaccggggaccttaaagggttacgttaacgtttaaccggttggttacggaacgaaaggtaagaacgtacgaacgtaagttaacggtaaaccggg

SEQ ID NO: 386271 - DNA, 559 bp, Homo sapiens
  misc_feature: GZ8MTXP01ELJVT.22.86.H09.1.454.CMB.2.raw
  modified_base (191)..(191): a, c, t, g, unknown or other
  modified_base (258)..(258): a, c, t, g, unknown or other
  modified_base (269)..(269): a, c, t, g, unknown or other
  modified_base (271)..(271): a, c, t, g, unknown or other
  modified_base (275)..(276): a, c, t, g, unknown or other
  modified_base (279)..(279): a, c, t, g, unknown or other
  modified_base (285)..(285): a, c, t, g, unknown or other
  modified_base (302)..(302): a, c, t, g, unknown or other
  modified_base (307)..(307): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgtaggctctttaagaggtgtcagtgtcaggtgcagntggtggagtctgggggagcgtggtccagcctgggaggtccctgagctctcctgtgcagcgtctggtntctctcagtgntntgcnngcncgcgcncgcgcgcgcggcgaggngtggnggtggtgacgtatagtagtgtagtaagagtaagtaaagtaaagtaaagtagtagtaggtacggtacgtacgtacggacggtacgtacgtacactactactacgacgaacgacaactaacaacgaacgtacttacttacgttactaactaactaacgaacgacgacgtagaggacggacggaacggacgacggtacgttagtagtacgttagttgttagaagagaagacgtacgacgtaacgttaagtaacgg

SEQ ID NO: 386272 - DNA, 563 bp, Homo sapiens
  misc_feature: GZ8MTXP01DO5S4.22.86.H09.1.454.CMB.2.raw
  modified_base (472)..(472): a, c, t, g, unknown or other
  modified_base (500)..(500): a, c, t, g, unknown or other
  modified_base (546)..(546): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttctttttaagaggtgtccagtgtcaggtgcagctggtggagtcgtgggggagcgtggtccagccgtggggacgtccctgagactctcctgtgcagcgtctggtattcaccttcagtggctagtggcatcgcacgtcggcctcccgccgacgggccgtccgggacgaagggggctggggaggtggggtagactaaagttaatagtggtatgaagtagggaaagtaataaagactagtgtggacgtcgtaggaacggcgtatcacatctacagacgaacaactacaaanaacactcttcgttcaaccaaatcgaacncgctaaggagaggacgaggacgcggacgttgttagtaattacgtgngagagaagaacgtaacg

SEQ ID NO: 386273 - DNA, 594 bp, Homo sapiens
  misc_feature: GZ8MTXP01DUJ4B.22.86.H09.1.454.CMB.2.raw
  modified_base (398)..(398): a, c, t, g, unknown or other
  modified_base (410)..(410): a, c, t, g, unknown or other
  modified_base (414)..(414): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaaggggctgggagtgggtggacaattatatggtatgaatggaaagtaaataaagactaatgtggactcgtgaaaggccgattcacatctaccagagaacaaactccaaagaacaactcttacgtttactaccaaaatcgaaaccaagcctggaagagggcgaaggacacgggntagtgtattacngtgngaagagatacgacaagttacgaacgttaaaggggaaactttcgtttagattcgtacggtacgggaaccgaaggactacgtcgtacctaccgttcctctaacaccgccctaccgaaccgtaacggcccttacgttcccggttccctccccggtcgcccgtccctcgcctaaccgcggaacc

SEQ ID NO: 386274 - DNA, 497 bp, Homo sapiens
  misc_feature: GZ8MTXP01EWR07.22.86.H09.1.454.CMB.2.raw
  modified_base (267)..(267): a, c, t, g, unknown or other
  modified_base (304)..(304): a, c, t, g, unknown or other
  modified_base (332)..(332): a, c, t, g, unknown or other
  modified_base (391)..(391): a, c, t, g, unknown or other
  modified_base (467)..(467): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggatcacttnagtgctatggcatgcactgactccgcaggctccgggnaagggggctgggagtgggtgacaattanagtggtatgatggaaataataaagctatgtgactcgtagaggcgatcacatctacaganacaactacaagaactctctcgttacaccaaatcgaacagcctgagacggcgaaggacacgggcagtgtaattacgngttagcgagaagatcgactaagttgaacgg

SEQ ID NO: 386275 - DNA, 582 bp, Homo sapiens
  misc_feature: GZ8MTXP01ARN7D.22.86.H09.1.454.CMB.2.raw
  modified_base (354)..(354): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgataggaaagtaaataaagactatgtggactcgtgaaggccgattcaccatctccagagacaactccaaagaacactctcgttctacaaatnaacaagcctgagagggcgaggacacggcagtgtattactgtgcgagagatacgacagtcgaacgtaacgggaaagtcgttttagattcgtacggtgggggaccgaagggaccacgtcggtcctaccgttctcttaacacgttccctaccaaccgaacggggccccttacgttcccggttccccttcccccgtcgggtcccgtcccctcggccctcccgaaggaacccg

SEQ ID NO: 386276 - DNA, 620 bp, Homo sapiens
  misc_feature: GZ8MTXP01D0HRD.22.86.H09.1.454.CMB.2.raw
  modified_base (315)..(315): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtggggggagcgtggtccagccgtgggagtccctgagactctcctgtgcagcgtctggatcacttcagtgctatggcatgcactggcctccgcaggccgtcccggggngaagggggctagggaggtggggtggaccaatttatagtggtatgaagtgggaaataaactaaaaggactagtggtagggactccgtaggaaacgggccgattccaacctaatcctaccaaggacaaacctaactaccaaagtaacctactttcttacgttttacctaacccaaattcgaaacacgtcccgtaggaacggacggggccggaaagggaaccgacggggacagggtttagttaactttaaccggttggttacggcggaaaggaagtaacgacggaactaagttaacggtaaaaccggg

SEQ ID NO: 386277 - DNA, 559 bp, Homo sapiens
  misc_feature: GZ8MTXP01AMV5B.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactcgtgaaggccgattcaccatctccagagacaactccaagaactactctcgtttcacaaatgaacaagcctgagaggcgagacacggcagtgtatactgtgacgagagatcgaacagtagaacgtaacggggaaagtcgttttaggattcgtacgtagggggcccaaaggggctaacgtgggtaccaccggttctcttcaacgttccctaccaccgaacgggcccttagttccggttcctccccgtggcctccctgcctccgaaggaacc

SEQ ID NO: 386278 - DNA, 626 bp, Homo sapiens
  misc_feature: GZ8MTXP01CAU1M.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtggggtggcaattatatggtatgatggaaagtaataaagactatgtggactccgtgaagggccgattcacatctaccagacgaacaactccaaagaacactctcgtttccacaaatgaacaagcctgagaggcgaggcacggcagtgtattacgtgtgcgaagagagtacgacagtagaaccgtaacggggaaagttcgtttttacggtaagttccgtacggttacgggggacccaaaggggtaccaacgttcgggtacctaacccggtcttccgtttcaacgttcccgtacccaacccgaaaccgggtcccttaccgttcccgggttcccctttcccccgtcggggtcccctccccgttcggcccgttcccgaacgggtaacccg

SEQ ID NO: 386279 - DNA, 541 bp, Homo sapiens
  misc_feature: GZ8MTXP01COARA.22.86.H09.1.454.CMB.2.raw
  modified_base (310)..(310): a, c, t, g, unknown or other
  modified_base (408)..(408): a, c, t, g, unknown or other
  modified_base (507)..(507): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgagactctcctgtgcagcgtctggatcaccttcagtggctatggcatgcactggcctccgcaggctccgggnaagggggctgggagtggggtggacctaattatagtggtatgaagtgggaaataaataaagactagtgtggactccggtagacgggcctatcacatccncagacgacaactacaaacgactactcttacgtttacaaccctaaatcgaaacacgcctaggaggaggcggaagggacacgggacaggtacgtattacgngttagcggagaagatcgactaagttgtaaaccgg

SEQ ID NO: 386280 - DNA, 606 bp, Homo sapiens
  misc_feature: GZ8MTXP01CBT09.22.86.H09.1.454.CMB.2.raw
  modified_base (251)..(251): a, c, t, g, unknown or other
  modified_base (259)..(259): a, c, t, g, unknown or other
  modified_base (280)..(280): a, c, t, g, unknown or other
  modified_base (548)..(548): a, c, t, g, unknown or other
  modified_base (557)..(557): a, c, t, g, unknown or other
  modified_base (576)..(576): a, c, t, g, unknown or other
tcagacatacgcgtcacgaccggtgctcgatttagtgctatagacttgagctctgggagaggagcccagcactagaagtcggcggtgtttccattcgctgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctctgngcagcgtntggattcacttcagtgctagnggcatgcacgtggcctccgccgaggccgtccggggcgaagggggctggggagtggggtacgactaaattagtacgtagggtaataggtaagtagggaaaagttaaataaagcttagtggtacgggtacctaccggtaggaacgggccgtaattaccgaaccctacgtacctaccgagaacgaaccaacgtaccaaagggtaacctactcttacgttacacctaaagtacgaactagccgtaggagacgggaacgaacggacgaccggntaagggttnttaacgttcgttgtaacgngaagaagagttacggtaacaagttaaccgg

SEQ ID NO: 386281 - DNA, 597 bp, Homo sapiens
  misc_feature: GZ8MTXP01CELH0.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaaataaagactatgtggactccgtggaagggccatcaccatctccagacgacaactaccaaagaacactcttacgtttccacaaaatgaaacaagtcctgagagggcgaggacacggcagtgtattactggtgacgtagagagtcgacagtacgaactaacggggaaagtcgtttttagaacttcgtcgtacgggggcccaaaggggctaacgtggtaccgacccgttctccgttcgaacgccctacccgaacccgtaaaccggggcccttacgttcccggttcccttcccccgtggccccgccctcggcctccgaaggaacccg

SEQ ID NO: 386282 - DNA, 581 bp, Homo sapiens
  misc_feature: GZ8MTXP01DOPUO.22.86.H09.1.454.CMB.2.raw
  modified_base (271)..(271): a, c, t, g, unknown or other
  modified_base (555)..(555): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtggggggagcgtggtccagccgtgggagtccctgagctctcctgtgcagcgtctggatcaccttnagtggctatggcatgcactggcctccgccagggcctcccgggggacaagggggctggggaggtggggtagacctaaagttgtagtggtatggaatgggaaattaaataaagactagtggtggaactccggtagaacgggccgattcacatcctaccagacaacaactaccaaagaactacttcttacgtttaccaaccgtaaattcgaaactacgccctaggaaggacggcggaaacggacgacgggcttaaggtagttacttaacgttggttacgaacgaagngaagtcggactaagttggtaaaccgg

SEQ ID NO: 386283 - DNA, 574 bp, Homo sapiens
  misc_feature: GZ8MTXP01DU013.22.86.H09.1.454.CMB.2.raw
  modified_base (404)..(404): a, c, t, g, unknown or other
  modified_base (418)..(418): a, c, t, g, unknown or other
  modified_base (497)..(497): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaagggggctgggagtgggtggcaattatatggtatgatggaaagtaataaagactaatgtggactccgtgaaagggccgattcaccatctccagacgacaactaccaaagaacactctcgtttacctacaaatgaaacaagcctggagagggacgaggaccacggcagtgtatactgngcgagagatcgaanagtagaacgtaagggtaattcgtttagactcgtacggtacgggaccgaaggactacgtcggtacctaccgtctctaacncgttccctaccgaccgaacggcccttacgttcccgttcccctccccgtcggcccgcccgtcgcctccgaacggaacg

SEQ ID NO: 386284 - DNA, 600 bp, Homo sapiens
  misc_feature: GZ8MTXP01EEY9G.22.86.H09.1.454.CMB.2.raw
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaaggggctgggagtgggtgcaattatatggtatgatggaagtaataaagactaatgtggactccgtgaagggccgattcaccatctccagagacaactccaagaacactctcgtttctaccaatagaacaagctcgagaggcgagacgacggacgatggtattactgtgacgagaagatcgacatagaacgtaacggggaaagtcgttttaggtataccgtcgttagggggccgaaacgggcgaaaccgtcgggttcaaccccggtttctacttcctaacggcccttcccaaaccgaaacggggtccccacgttccggggttccccttcccccgtgggcccggtcccctcggacctccgaaggggaacccg

SEQ ID NO: 386285 - DNA, 554 bp, Homo sapiens
  misc_feature: GZ8MTXP01B8P6E.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtgcaaattatatggtatgatggaagtaataaagactatgtggactccgtgaagggccgattcaccatctccagagacaactccaaagaacactctcgtttctacaaatgaacaagcctgagaggcgaggacacgggcagtgtatactgtgcgagagatcgacatgaactacgggaaagtcttttaggacttcgtcgtggggacccgaaggggacaacgtggtccgtacgtcctcttcacgttccctaccaaccgaaacgggcccacgttcgttcccgttccccctggccgccctgcctcgcgggaaccg

SEQ ID NO: 386286 - DNA, 601 bp, Homo sapiens
  misc_feature: GZ8MTXP01DAH8L.22.86.H09.1.454.CMB.2.raw
  modified_base (315)..(315): a, c, t, g, unknown or other
  modified_base (339)..(339): a, c, t, g, unknown or other
tcagacatacgcgtcacgaccggtgctcgatttagtgctatagacttgggtttgggctgagctgggttttcctcgttgctctttttaagaggtgtccagtgtcaggtgcagctggtggagtctgggggaggcgtggtccagcctgggaggtccctgagactctcctgtgcagcgtctggattcaccttcagtgctatggcatgcactggctccgcaggctccgggcaaggggctgggagtgggtgacaattatatggtatgatggaaagtaataaagactaatgtggactcgtgaaagggccgattcaccattcnccagacgaacaactccaaagaacnctctcgttacacaatcgaacagcctgagagacgagacacgggcagtgtattactgtgcgaagagatacgacagtagaacgtaacgggaaagttcgtttagacttcgtacggtaggggacccgaaggggtacaacggtcgtaccacccgttctcgttccacggttaccctacccgaacccgaaacggggtccccttaacgttcccggttaccccgttccccgtcgggtccccgtcccgtacgttaccgtccgaacggtaaccg

SEQ ID NO: 386287 - DNA, 602 bp, Homo sapiens
  misc_feature: GZ8MTXP01DJC9B.22.86.H09.1.454.CMB.2.raw
  modified_base (307)..(307): a, c, t, g, unknown or other
  modified_base (318)..(318): a, c, t, g, unknown or other
  modified_base (369)..(369): a, c, t, g, unknown or other
  modified_base (513)..(513): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtctgggggagcgtggtccagcctgggaggtccctgagactctcctgtgcagcgtctggatcacttcagtggctatggcatgcactggcctccgccaggctccgngacgagggcgnggaggtgggtcgactaattatagtggtaatagtaagtagggaaagttaaanaaagtactagtggtacggtacgtaccggtaggaacgggctacttaccaactactccgtacagaacgaactaaaccaccgaaacggtaacctacttcgttacgtttacctaacctaaagtacgaaacgacgtaccgaggaacggngggaaccgaagggaccgaccggacgtaaggttagttaaccgttgttaggtgggaagaaggtaacgagttacgtaacgttaagtaaccgg

SEQ ID NO: 386288 - DNA, 522 bp, Homo sapiens
  misc_feature: GZ8MTXP01ALB9R.22.86.H09.1.454.CMB.2.raw
  modified_base (377)..(377): a, c, t, g, unknown or other
  modified_base (501)..(501): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggacttcaccttcagtggctatggcatgcactggctccgcaggctccgggcaaggggctgggagtgggtgcaattaagatggtatggatggaaagttaanaaagctagtgtggactccgtagagggccgatcgacatctcagagacaactccaagaaccactctgttctaccgaaatgaactagcctaagagagggcgaggacgacggcttgttgtaagttacnggtgcggagaagaacgtaacg

SEQ ID NO: 386289 - DNA, 619 bp, Homo sapiens
  misc_feature: GZ8MTXP01BRPJO.22.86.H09.1.454.CMB.2.raw
  modified_base (392)..(392): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtgctaattatatggtatgatggaagtaataaagactatgtggactccgtgaagggccgattcaccatctccagacgacaactccaaagaacactctcgtttctacaaatgaacagccctgagaggcgaggacaggcagtgtattacngtagcgagtagattacgacagtgaacgtaacggggaaagttcgtttttaggaattccgtacggtcggggacccgaaagggggactaacgttcggtaccgtaacccggttctccttaacgacggttaccccttacccgaaccgtaaacggggtccccaacggttcccgggttcccttccccccggttgggccccgtcccgttccgccgttcccgaaggggtaaccccg

SEQ ID NO: 386290 - DNA, 565 bp, Homo sapiens
  misc_feature: GZ8MTXP01DQZRU.22.86.H09.1.454.CMB.2.raw
  modified_base (308)..(308): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctggggagtccctgacgactctcctgtgcagcgtctggatcacttcagtggctatggcatgcactgctccgcaggctccgggnaagggggctgggagtggggtgacctaagttatagtggtatagatgggaaataaataaacgactatggtagggactccgtagaacgggcattcacatcacagacacaactacaacgaactaccttcttacgtttaccaacctaaaatcgaaacgacgtccgtaggaagacgggcggaaacggacacggggacaggttagttacttagttggttcgaaggaaaggaacgtagtaccggactaagttcggtaaaaccggg

SEQ ID NO: 386291 - DNA, 549 bp, Homo sapiens
  misc_feature: GZ8MTXP01EP4RW.22.86.H09.1.454.CMB.2.raw
  modified_base (388)..(388): a, c, t, g, unknown or other
  modified_base (484)..(484): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaagtaaataaagactaatgtggactccgtgaagggccgattcaccatctccagagacaactccaaagaacactctcgtttctacaaatgaacaagccctgagaggcgaggacacggcagtntattactgtgcgagagatcgacatgaactaacggggaaagtcggttttagattcgtcgtcgggggaccaagggacacgtggtccaccgtctcttcncgcctcccgacaacgggcccacgttccggttcctcccctggccctcccgtgcctccgaacgggcc

SEQ ID NO: 386292 - DNA, 616 bp, Homo sapiens
  misc_feature: GZ8MTXP01A84AX.22.86.H09.1.454.CMB.2.raw
  modified_base (375)..(375): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggagcgtggtccagccgtgggagtccctgagactctcctgtgcagcgtctggattcaccttcagtggctagtggcatgcactcggctcccgccagggccgtccggggcaagggggctgggacggtggggtggactaaagtttanagtggtatggaagttagggaaagtaaataaagactaagtggtaggacttcggtaggaaggggccctaattccaacctaagtcctaccgaagacgaacaaactaccgaaagaacctacttcctagtttaccaacccaaattcggaaactcgccctaaggaacgttagggacggaagggaaccgacggggttacagttcggtaatttaccgtaaggtcgggacgaaggaagttaactaaccgg

SEQ ID NO: 386293 - DNA, 558 bp, Homo sapiens
  misc_feature: GZ8MTXP01CKJ7X.22.86.H09.1.454.CMB.2.raw
  modified_base (229)..(229): a, c, t, g, unknown or other
  modified_base (389)..(389): a, c, t, g, unknown or other
  modified_base (407)..(407): a, c, t, g, unknown or other
  modified_base (535)..(535): a, c, t, g, unknown or other
  modified_base (554)..(554): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcacctttcagtggctatggcatgcactggctccgccaggctccgggnaaggggctgggagtgggtggcaattatagtggtatgataggaaagtaaataaagactatgtggactcgtagaaggcgatcacatctccagagacaactacaagaacactctcgtttcacaaatcgaacaagctgagaggacgagacacggcagtgtatcngtgacgagagatcgacancgaactaacgggaaattcgtttagatcgtcggtacgggggaccaaaggggactacgtcggtacctaccgtctcttcaacgttccctaccgaccgtaacgggccccttagttccggttcccttccccgngccctcctcgcctaaccgngccg

SEQ ID NO: 386294 - DNA, 588 bp, Homo sapiens
  misc_feature: GZ8MTXP01BT2RP.22.86.H09.1.454.CMB.2.raw
  modified_base (272)..(272): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttnagtggctagtggcatgcacgtggcctccgccgaggccgtccgggggcaagggggctgggaggtgggggtacggactaaagttatagtggtatggagtaggaaaaataaataagactagtggtaggactcggtagaacgggctatcacatccacaagacaacaacacaaagaactacgtacttcggttactaaccgaaatacgaaaccacgaccgtaggaacggacgggccggaaggaccgacgggaactaggttgttaacttacgtggtcgaggagagtaatccggaactagtacggacgttaacgggaagtttcg

SEQ ID NO: 386295 - DNA, 544 bp, Homo sapiens
  misc_feature: GZ8MTXP01EJIWL.22.86.H09.1.454.CMB.2.raw
  modified_base (270)..(270): a, c, t, g, unknown or other
  modified_base (312)..(312): a, c, t, g, unknown or other
  modified_base (503)..(503): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcgtctggatcacttnagtgctatggcatgcacgtggcctccgcaggccgtcccgggnaagggggctgggaggtggggtgaccaagttatagtggtatgaatgggaaataaataaagctagtggtagactcgtagaggcgattcactatcacagacgacaactacaagaactactcgttagtttaccaacaaatagaacaacgccgtaggagacggcgaaggaacacgggcttagtacgttaattacgngttaggaacgagtaagactcggactaagttcgtaaaccggg

SEQ ID NO: 386296 - DNA, 532 bp, Homo sapiens
  misc_feature: GZ8MTXP01C64TL.22.86.H09.1.454.CMB.2.raw
  modified_base (313)..(313): a, c, t, g, unknown or other
  modified_base (475)..(475): a, c, t, g, unknown or other
  modified_base (494)..(494): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgagactctcctgtgcagcgtctggattcaccttcagtggctatggcatgcactggcctccgcaggctccgggnaagggggctggagtgggtgacaattatagtggtatgataggaaaagtaataagactagtggtggactccggtgaaacgggccgtattcacctatctaccaagagacaactacaaagaacactctgtttactacaaatcgaacagcctagagaggcgaggacnggcagttgtattacgtggngacgagagaatagaacagtagactaacggggaatttcg

SEQ ID NO: 386297 - DNA, 585 bp, Homo sapiens
  misc_feature: GZ8MTXP01BEVH5.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtgcaattatatggtatgataggaaagtaataaagatatgtggactcgtagaagggccgattcaccatctccagacgacaactaccaaagaacactctcgtttcacaaatgaacaagcctgagaggcgaggacacggcagtgtattactgtgcgagagatcgacatagaacgtaacgggaaagttcgtttagagttcgtacggtacggggaccaaggggactacggtcggtaccgtaccgttctccgttcacgttccctacccgaccgaaaccgggcccttacgttcccggttccctttcccccgcggtcccgtccccgtcgacccgtccgaacggaaccg

SEQ ID NO: 386298 - DNA, 612 bp, Homo sapiens
  misc_feature: GZ8MTXP01DRGOV.22.86.H09.1.454.CMB.2.raw
  modified_base (340)..(340): a, c, t, g, unknown or other
  modified_base (393)..(393): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgcaggctccgggcaaggggctgggagtggggtgctaattatatggtatgatggaaagtaataaagactatgtggactcgtgaaaggccgatcaccatctccaagacgaacaactaccaaagaacnctcttgtttcctaccaaatgaacacgcctggagacgggcaggacagggcagtntatactggtgacgaagagatcgaacagtagaacgtaaacggggaaagttcgttttaggattaccgtcggtacgggggacccgaaaggggactaacgttcgggtacctacccggttcttccgttcgacgttccccgttaccccgaaaccggaaccgggtccccttacgttcccggttccccttcccccgtggccccgtccctcggcctcccgaagggccc

SEQ ID NO: 386299 - DNA, 656 bp, Homo sapiens
  misc_feature: GZ8MTXP01A94AF.22.86.H09.1.454.CMB.2.raw
  modified_base (390)..(390): a, c, t, g, unknown or other
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggcctccgccaggctccgggcgaaggggctgggagtggggtgctaattatatggtatgataggaaagtaaataaagactatgtggactccggtagaaggccgattcaccatctccagacgacaactaccaaagacactctcgttactacaatgaacagcctgagaggcgagacgacgcagtntatcngtgacgtagagatcgacagttagacgtaacgggaagttcgtttagattaccgtcggtacggggaaccgaacggggctaaccggtcggtcccgttaaccccggttcttcccgttaaccgaccgttaccccgttacccgaaccccggaaaaccgggggttcccccttaacggtttccccgggggttaccccccttttcccccccgggtcggggcccccgttccccccgttaggcccccgtttcccggaaaccgggtcccccgg

SEQ ID NO: 386300 - DNA, 740 bp, Homo sapiens
  misc_feature: GZ8MTXP01D0ON1.22.86.H09.1.454.CMB.2.raw
  modified_base (228)..(228): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgcaggctccgggnaaggggctgggaggtgggtgacaattatatggtatgataggaaagtaaataagatagtgtggactcgtaggaaaggccgattcaccatctaccagacgaacaactaccaaacgtaacaccttcctttacgtttacctaacctaaaagttacgaaaaccaacgggtacccttaagggaaacgggaacggggaaccggaaacgggaacccgaacgggggactaaggtttagttaaagtttaaccgtgggtacggacggaaaggaagtaacgttacgaaccgtaagttacggaaacggttaaaccggggtaaaagtttccgtttttaggaactttccgttacgggtacgggggacccgtaaacggggtacctaaccgttcgggttacctaacccggttcttccgttaaccaccgttacccctaccccgaaaccggaaaccgggccccttacggttccccggtttccccttccccccggtcggccccgtcccgtcgccctaaccgaacggaacccg

SEQ ID NO: 386301 - DNA, 553 bp, Homo sapiens
  misc_feature: GZ8MTXP01BHJTW.22.86.H09.1.454.CMB.2.raw
  modified_base (308)..(308): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcaccttcagtggctatggcatgcactggctccgccaggctccgggnaagggggctgggagtggggtggacctaattatagtggtatggataagggaaagtaaataaaggactaagtggtaggacgtccgtggaaacggggccgtattccacctatcctaccagaacgaacaacgtaccaaacgaaacctacttcttacgtttacctaccaaaatgaaacgagccgtagagcgggcgaagggacacgggcagtagtattcgttgttggcgagaagatcgactgttgaaccgg

SEQ ID NO: 386302 - DNA, 536 bp, Homo sapiens
  misc_feature: GZ8MTXP01DMO3U.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctggggagtccctgagactctcctgtgcagcgtctggattcaccttcagtggctatggcatgcactggcctccgccaggcctccggggcaagggggctggggaggtggggtgctaaagtttatagtggtatgagtagggaataataaagactatgtggactcggtagaacgggcgattcacatctcagagacaactcaaagaacactctgttctaccaaatgaacacgcctaaggaagagggcgaggacgcggacgttagttcgtaattacgtgtgcgagaagcgtaacgg

SEQ ID NO: 386303 - DNA, 637 bp, Homo sapiens
  misc_feature: GZ8MTXP01AVOP4.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctgacgactctcctggtgcagcgtctggatcaccttcagtgctatggcatgcacgtgggcctcccggaccgagggccgtcccgggggacgaaggggggcctggggaggtgggggtaggacctaaagtttagtagttgggtagtaggaagttaagggaaagttaaataaaggtacttaagtgggtagggtacccgtccgggtaggaaacggggtacccgtaattacccacctaatcctaccaaggacaaccaaacctaccgaaacgaacctacttcttacgtttacctaaccaaaatacggaaaccaaggtccctagggaggacggcggaacggaaccacgggcagtaggttaacttagttgttcggaagaggaagagtcgaactaagttaacgaacgg

SEQ ID NO: 386304 - DNA, 592 bp, Homo sapiens
  misc_feature: GZ8MTXP01ADAJ9.22.86.H09.1.454.CMB.2.raw
  modified_base (253)..(253): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattanatggtatgatggaaagtaataaagactatgtggactccgtgaaagggccgattcaccatctccagagacaactccaaagaacactctcgttctacaaatgaacaagcctgagaggcgagacacggcagtgtattactgtgcgagagatacgacagtagaacgtaacgggaaagtcgttttagattcgtacgtaggggacccaaaggggacctaacgtgggtcctacccggttcttcctttccgaacgttcccctacccgaacccgaaacgggtccccttacgttcccgggttcccttcccccggtggcccgccccttcggcccttccgaacgggtcccg

SEQ ID NO: 386305 - DNA, 648 bp, Homo sapiens
  misc_feature: GZ8MTXP01A09Y7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgccaggctccgggcaaggggctgggagtgggtggcaattatatggtatgatggaaagtaataaagactatgtggactcgtgaagggccgattcaccatctcagagacaactcaagaacactctcgtttcacaaatgaacaagcctgagaggcgaggacacggcagtgtattacgtgtgacgagtagatacgactagtgaacgtacgggaaaagtcgttttagaacgttccgtacggttagggggaccccgaaaggggtaccgtaaccgttcgggtacccgtaaccccggttcctttcccgtttccgaaccggttccccttaccccgaaccccgaaaccgggggtcccccttaacggttccccggttccccgttcccccccgttccggggtccccgtccccccgttcggaccccgtttccgaaccggggtcccg

SEQ ID NO: 386306 - DNA, 555 bp, Homo sapiens
  misc_feature: GZ8MTXP01ENEFI.22.86.H09.1.454.CMB.2.raw
  modified_base (271)..(271): a, c, t, g, unknown or other
  modified_base (315)..(315): a, c, t, g, unknown or other
  modified_base (345)..(345): a, c, t, g, unknown or other
  modified_base (503)..(503): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcctgtgcagcgtctggatcacttnagtggctagtggcatgcacgtggcctccgcgaggctcccggggnaagggggctgggagtgggtgcctaatttanagtggtatagatgggaaataaataaagctaagtggaggtactcgtagaacgggtccgattccgactatctaccagacaacaactaccaaagaacctacttcgttagtttaccaactaaatcgaacagtccctagacggacggcgaacggacaccgggnaggtgtaattacgttgttacgaagagaagactcgactaagttaacgaaccgg

SEQ ID NO: 386307 - DNA, 798 bp, Homo sapiens
  misc_feature: GZ8MTXP01CGO27.22.86.H09.1.454.CMB.2.raw
  modified_base (189)..(189): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtcgtggggagcgtggtccagcctgggaggtccctgagactctcctgtgcagcgtctggattccaccttnagtggctatggcatgcactggcctccgccaggccgtccgggacgaaggggctgggaggtgggtgactaattatagtggtatgaagtaggaaataaataaagtatagtggtacgacgtccggtaggaaacgggcctaattccacctattaccaccgaagaacgaaccaaacctaccgaaagaacctacttcttacccgtttaccaacctaaaagtcgaaaccgtaacgtcccgtaaggaaacgggaacgggacggtaaacgggaaccgaaccggggacttaaaggttacgtttaaatttacgggtaggtacggaacggtaaagtaacgtacgtaccgaaagtaagtaaacgggtaaaccggttaaacgggttaaactttcggtttaacggaccgttccggtacggggtaaccggggaaacccgtaaacgggtaccttaccggttccggtaaccctacccgttccttacccgttaaccccgacccgttacccccgtaaacccgaaacccggtacccggttcccctttcccgggtttcccccgttacccccgttccccggcccggttccccgtccccgtacgttaccccggtaacccggaacggtaaccccg

SEQ ID NO: 386308 - DNA, 573 bp, Homo sapiens
  misc_feature: GZ8MTXP01DFHE2.22.86.H09.1.454.CMB.2.raw
  modified_base (227)..(227): a, c, t, g, unknown or other
  modified_base (477)..(477): a, c, t, g, unknown or other
  modified_base (533)..(533): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggagcgtggtccagcctgggaggtccctgagactctcctgtgcagcgtctggattcaccttcagtggctatggcatgcactggctccgccaggctccgggnaagggggctgggagtgggtgctaattatatggtatgatggaagtaaataaagactatgtgactcgtgaaggccgatcacatctcagagacaactcaagacactctcgttactacaaatgaacaagcctgagagcgagactacgggcagtgtattactggtgcgagagagtacgacatagaacgtacggggaaatcgttttagagttctacggaggggccaaggggcacgtgtccgaccgttctcttaacncgccctccaacccgaacgggtccccttaacggttcccggttcccctttccccccgnggtccccgccccgttcggcccttaacccgaacgggtcccg

SEQ ID NO: 386309 - DNA, 642 bp, Homo sapiens
  misc_feature: GZ8MTXP01DFXI1.22.86.H09.1.454.CMB.2.raw
  modified_base (327)..(327): a, c, t, g, unknown or other
  modified_base (347)..(347): a, c, t, g, unknown or other
  modified_base (612)..(612): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggcctccgcgacggcgtccgggacgaaggggctgggaggtgggtgactaattatagtggtatgataggaaataaataaagactagtggtcggactcggtagaacggccattcaccatcncagagacaactacaagaacnctctacgtttcacaaatcgaactacgcctggagacgggacggaacgggacgacgggactaggttacgttaattacgtggtacggacggaagacgaattaccgaactagtacgaaacggttaaacggggaaacgtttgttttaggaacttccgttacgggacgggggaccaaacggggtctaaccggtcggtacctaccggtcctcgttaaccgacgttccctaccgaaccggacggtcccttacgttcccgttccctttccccgnggcccctcccgtgcctccgaacgggaaccc

SEQ ID NO: 386310 - DNA, 537 bp, Homo sapiens
  misc_feature: GZ8MTXP01DOFVX.22.86.H09.1.454.CMB.2.raw
  modified_base (463)..(463): a, c, t, g, unknown or other
  modified_base (493)..(493): a, c, t, g, unknown or other
  modified_base (507)..(507): a, c, t, g, unknown or other
  modified_base (529)..(529): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggtccagccgtgggagtccctgagactctcctgtgcagcgtctggatcaccttcagtggctatggcatgcactggcctccgcaggctccgaggcgaagggggctggggagtggggtcggactaaagttatagtggtaatgaagtagggaaagtaaataaagctagtggtagactcgtaggaacgggcattcacatcacagacgacaactaccaagactacttctacgttacaccaaatcgaaacncgtcctaggacggaggcggaaggcacgggntagtgttagttcgnggtgacgaagagacttacgaanaagtaagg

SEQ ID NO: 386311 - DNA, 501 bp, Homo sapiens
  misc_feature: GZ8MTXP01AD61M.22.86.H09.1.454.CMB.2.raw
  modified_base (352)..(352): a, c, t, g, unknown or other
  modified_base (370)..(370): a, c, t, g, unknown or other
  modified_base (456)..(456): a, c, t, g, unknown or other
  modified_base (483)..(483): a, c, t, g, unknown or other
  modified_base (495)..(495): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctcgccaggctcgggcaggggctggaggtggtgcaattanatggtatgatggaataanaaagctatgtggactcgtgaagggccgattcaccatctccagagacaactcaagaccactctgttcacaaatcgaacagcctgagngggcgaggacacggcagttgtaatagngtgcgagtaagngtaacg

SEQ ID NO: 386312 - DNA, 552 bp, Homo sapiens
  misc_feature: GZ8MTXP01BH5NN.22.86.H09.1.454.CMB.2.raw
  modified_base (480)..(480): a, c, t, g, unknown or other
  modified_base (525)..(525): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggcaattatatggtatgatggaaagtaataaagactatgtggactcgtgaaaggccgattcaccatctccagagacaactccaaagaacactctcgtttctacaaatgaacaagcctgagagggcgaggacacggcagtgtattactgtgcgagagatcgacatgactacggggaaatcgttttagatcgtcgtggggcccaaggggacacgtcggtccacccgttctcttcncgccctccacgaacgggcccttacgttccggttcccttcccccgnggcccgccctcgcctccgaagggaacc

SEQ ID NO: 386313 - DNA, 640 bp, Homo sapiens
  misc_feature: GZ8MTXP01AFA5V.22.86.H09.1.454.CMB.2.raw
  modified_base (272)..(272): a, c, t, g, unknown or other
  modified_base (358)..(358): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccctgagtacctctcctgtgcagcgtctggatcaccttnagtggctatggcatgccacgtggcctcccgccgagggccgtcccggggcgaagggggctggggaggtggggtggacctaagtttanagtggtagtcgaagtaaggtaaacgtaaataaagcttaagtgggtagtaccgtccggtaggaacgggtaccgtattccacgtactcctaccgaagaacgaaccaaccgttacgaacgaaacctacttacgttctttacctaaccctaaagtacgaaaccgtacgtaccgtgaaaggacgggaccggaacggaacgaccggggacttagggttagttaacgtttacgttcgggttagaacgggaagtaaggtcgtacgacgtaaggttaacggtaaacccggg

SEQ ID NO: 386314 - DNA, 650 bp, Homo sapiens
  misc_feature: GZ8MTXP01B6LYX.22.86.H09.1.454.CMB.2.raw
  modified_base (386)..(386): a, c, t, g, unknown or other
  modified_base (393)..(393): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtgcaattatatggtatgatggaaagtaaataaagactatgtggactccgtgaaaggccgattcaccatctccagagacaactccaagaacactctacgtttcacaaatcgaacaagcctgagagggcgaggacacgggcagtntattacngtgcgaagagactcgaacagtagaacgtaacggggaaaagttcgttttagaacgttccgttacggtacgggggacccaaagggggtcctaaaccgtcgggttacccaacccgggtttccttccgtttaacccgaacgttccccttaccccgaaccgaaaccgggggtcccccttaaacgttcccgggttacccctttcccccccggttcgggccccgtcccccgttgggaccccttccccggaaaggggtaaccccg

SEQ ID NO: 386315 - DNA, 640 bp, Homo sapiens
  misc_feature: GZ8MTXP01AXQI1.22.86.H09.1.454.CMB.2.raw
  modified_base (269)..(269): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagctctcctgtgcagcgtctggatcaccttnagtggctatggcatgcactggcctccggccaggcctccggggcaagggggctggggagtggggtggacctaaatttagtagtgggtaataggaagttgggaaaagttaaataaaaggacttaagtgggtacggtacctccggtagaacggggccgtagttaccaacctaatctaccaagacgaaccaaacttaccaaacgaaacctacttaccgtttacgtttacctaaccctaaaagttccgaaacacgggtcccctaagggaacggacgggaccggaaacgggaaccgaacgggccgttaaggtaggttaacttacgttggttcggaaggaagaagtaacgtccggaactaagttaacgggtaaaccgg

SEQ ID NO: 386316 - DNA, 524 bp, Homo sapiens
  misc_feature: GZ8MTXP01C8QXO.22.86.H09.1.454.CMB.2.raw
  modified_base (310)..(310): a, c, t, g, unknown or other
  modified_base (326)..(326): a, c, t, g, unknown or other
  modified_base (330)..(330): a, c, t, g, unknown or other
  modified_base (378)..(378): a, c, t, g, unknown or other
  modified_base (510)..(510): a, c, t, g, unknown or other
  modified_base (520)..(520): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtgacaattatatggtatgataggaaagtaaataaagactatgtggactcgtgaaggcatcacatcncagacgacaactcaanaacnctctcgttcacaatcgaacaagctgagacggacgaggacacggcagtntattactgtgcgagagactacgacagtagacgtaacgggaaatcgttttagacttcgtcgtgggacccgaaggacacgtggtctaccgtctctcacgcctccacgaacggccacgttcgttcctccctgccncctgcctcgngccg

SEQ ID NO: 386317 - DNA, 610 bp, Homo sapiens
  misc_feature: GZ8MTXP01DOEP3.22.86.H09.1.454.CMB.2.raw
  modified_base (226)..(226): a, c, t, g, unknown or other
  modified_base (382)..(382): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgcaggctccgggnaaggggctgggagtggggtggacaattatatggtatgataggaaagtaataaagactatgtggactccgtagaaggccgattcacatctccagagacaactcaaagaacactctcgttactacaaatgaacagcctgagagcgagacacggcagtntattactgtgacgagaagatacgacatagaacgtaaacgggtaaagtcgttttaggattccgtacggtacggggaaccgaaacggggtaccaacggttcgggtccctaaccggttcctctttaaccaacggttcccctacccgaaacccgaaacggggtccccttaacgttcccggttccccttcccccgtggccccgccccttcggccctaaccgaacggtaacccg

SEQ ID NO: 386318 - DNA, 609 bp, Homo sapiens
  misc_feature: GZ8MTXP01EME4H.22.86.H09.1.454.CMB.2.raw
  modified_base (255)..(255): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtgggtggcaattanatggtatgatggaaagtaaataaagactatgtggactccgtgaaaggccgattcacatctccagagacaactcaaagaacactctcgttcacaaatgaacaagcctggagagggcgaggacacggcagtgtattactgtagcgaagagatacgacatacgaacgtaacgggaaagttcgttttaggaattccgtcggtacgggggacccaaacggggactaacgtcgggtccctaacccggttcttccttccaacggttcccctaccccaaccgaaaccggggtccccttaacgttcccgggttcccttccccccgtggccccgtcccctggcccttaacccgaagggaacccg

SEQ ID NO: 386319 - DNA, 612 bp, Homo sapiens
  misc_feature: GZ8MTXP01CT8VC.22.86.H09.1.454.CMB.2.raw
  modified_base (355)..(355): a, c, t, g, unknown or other
  modified_base (560)..(560): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagtcgtggtccagccgtgggagtccctgagactctcctgtgcagcgtctggattcaccttcagtgctatggcatgcacgtggctcccgccaggcgtccgggacgaaggggctgggaggtgggnggactaatttaagtagtggtatggaagtagggaaagtaaataaagactagtgtaggactccgtaggaacgggtcctagttccaacctatacctacaagaacgaacctaaacctaccgaaaacgtaacctaccgttcttacgtttacctaaaccctaaaagtcgaaacctacgcccgtaaggaacggagggaccgagggaaaccgnggggaaccttggttagttaattacgtggtgacggagaacgttaacgtaacgg

SEQ ID NO: 386320 - DNA, 624 bp, Homo sapiens
  misc_feature: GZ8MTXP01CJAX0.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtggcaattatatggtatgataggaaagtaaataaagactatgtggactcgtgaagggccgattcacatctcagagaacaactaccaaagaacactctcgtttacacaaatgaacaagcctgagaggcgaggacacgggcagtgtattacgtgtgacgagagacgtacgaacagtcgaaacgtaacggggtaaagttcgttttagaacgttccgtacggtacgggggacccgaaaggggtacctaacggttcggtaccctaccggttccttccgttaaccacggttcccctacccaccggtaaaccgggtccccttacgttcccggttccccttcccccgtgggtcccctcccgtcggacccttccggaacgggtaacccg

SEQ ID NO: 386321 - DNA, 616 bp, Homo sapiens
  misc_feature: GZ8MTXP01B4R66.22.86.H09.1.454.CMB.2.raw
  modified_base (318)..(318): a, c, t, g, unknown or other
  modified_base (353)..(353): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggaggtccctgagactctcctgtgcagcgtctggatcaccttcagtggctatggcatgcacgtggcctccgccgaggccgtcccggggngaagggggctgggaggtggggtgacctaaagtttnagtgggtataggaagtaagggaaagttaaacgtaaaagacgttagtggtacgggaaccgttccggtaggaacggggccgtacttaccaacctatcctaccgagaacgaacaaacctaccaaacgaacctacttacgttactttacctaacctaaaagtcgaaactacggaccgtaggaacggacgggacggaacggaacgacgggacttaggtagtattacgttggttacgaacgagaagactcgactaagttggtaaaccgg

SEQ ID NO: 386322 - DNA, 540 bp, Homo sapiens
  misc_feature: GZ8MTXP01ALXS5.22.86.H09.1.454.CMB.2.raw
  modified_base (342)..(342): a, c, t, g, unknown or other
  modified_base (518)..(518): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcaccttcagtggctatggcatgcactggcctccgccagggctccgggcaagggggctgggaggtggggtggacctaattntagtggtatgatgggaaataaataaagactagtggtggactccgtagaacgggccgattcaccatctccagacgacaactaccaaagaccactcttcgtttactaccaaatcgaacgacgccgtagagacgggcggaaggacgacgggtcaggttagtattacgttggttgcgagngagtcggactaagttcgaacgg

SEQ ID NO: 386323 - DNA, 596 bp, Homo sapiens
  misc_feature: GZ8MTXP01BBBOI.22.86.H09.1.454.CMB.2.raw
  modified_base (240)..(240): a, c, t, g, unknown or other
  modified_base (264)..(264): a, c, t, g, unknown or other
  modified_base (274)..(274): a, c, t, g, unknown or other
  modified_base (361)..(361): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaangcacccaggcaaacgccccagacncatcatttangctgtcaataagcggccctcgacggggtccctgactcgctttctctggctccaagtctcggccaacgaccggccctccctagacccntcctcgtgggcctccgagggctagaagatgaggctgattatactgctgctctatttcgcgacggccgtccttacgtacgtttggggtcggttccggggacgggaacggggtacccaaggtcccgttcggaacccggttcccgttagggtccaccggaccccgtaagggcccttccggccccccgttcgggtccctaaccgttccttcccggtttcccccaaccccgttcctcccg

SEQ ID NO: 386324 - DNA, 536 bp, Homo sapiens
  misc_feature: GZ8MTXP01AI1I2.22.86.H09.1.454.CMB.2.raw
  modified_base (346)..(346): a, c, t, g, unknown or other
  modified_base (352)..(352): a, c, t, g, unknown or other
  modified_base (514)..(514): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggcaattatatggtatgatggaagtaataaagactaatgtggactccgtgaaagggccgattcaccatctccagagacaactcaagacactctgtttcncaaatnaacaagccctgagaggcgaggacacggcagtgtattactgtgcgagagatcgacatgaactacgggaaagtcgttttgatctcgtggggccaagggtacacgtggtccaccgtctcttcacgttcctccacgaacgggcccagttcccggttccttcccccnggccgccctgcctccgaaggcc

SEQ ID NO: 386325 - DNA, 684 bp, Homo sapiens
  misc_feature: GZ8MTXP01DG289.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggatcacttcagtggctatggcatgcactggcctccgccaggcgtcccggggcgaagggggctgggaggtggggtggacctaaatttagtagtgggtatagaagtaagggaaagtaaagtaaaagacgttaagtaggtagggaaccgtacccggtaggaaacggggtacccgtaagtttacccaaccctaacgttaccttacccgaaggaacgaaaccaaaccttaacccgaaacgaaaccgttaacccttacctttaacggttttaccttaacccctaaaattacggaaaccaacggtacccgtaggaagggaacgggaacggtaacgggaaccgacgggaccgttaaggttacgttaagtttaacgttggttacggcggtaaaggaacggaattaccgggaactaagttaacggtaaaccggg

SEQ ID NO: 386326 - DNA, 521 bp, Homo sapiens
  misc_feature: GZ8MTXP01B9URP.22.86.H09.1.454.CMB.2.raw
  modified_base (311)..(311): a, c, t, g, unknown or other
  modified_base (316)..(316): a, c, t, g, unknown or other
  modified_base (318)..(318): a, c, t, g, unknown or other
  modified_base (321)..(321): a, c, t, g, unknown or other
  modified_base (334)..(334): a, c, t, g, unknown or other
  modified_base (446)..(446): a, c, t, g, unknown or other
  modified_base (450)..(450): a, c, t, g, unknown or other
  modified_base (462)..(462): a, c, t, g, unknown or other
  modified_base (477)..(477): a, c, t, g, unknown or other
  modified_base (504)..(504): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagtctgggttttcctcgttgcttcttttaagaggtgtccagtgtcaggtgcagctggtggagtcgtgggggaggcgtggtccaggcctggggagtccctgagcttctcctgtgcagcgtctggatcacttcagtggctatggcatgcactggctccgcaggctccgagngaggngnggngtggcgatagttnagtgtaatagtaagtaggtaaactaaataacgatagtggacgtacgtcgaggacggctatccgaactctcacgagacaacaactacgaagactatcttagtaccaacaatanaacncgcgtagacggnggaacgacgacgcgngtagtattacgttgttgcgagaagagnacgaagttaagtaacgg

SEQ ID NO: 386327 - DNA, 624 bp, Homo sapiens
  misc_feature: GZ8MTXP01BA0YU.22.86.H09.1.454.CMB.2.raw
  modified_base (268)..(268): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggatcaccttnagtggctagtggcagtgcacgtggcctcccggcagggcctcccgggggagaaggggggctggggaggtggggtagacctaagtttatagtgggtataggagtaagggaaagttaaactaaagacttagtcgggtaggaccctcggtaggaacggggacctacgttaccaacccgtaccgtacccccgaagaaccgaaccaaaccgtacccgaaaagtaaccctaacggttacttacgtttaaccaaccctaaagtacgaaacgtacgaccgtgaacggaggaccggaggaaccgacggacgtagttcgtattacgttggttgacgaagtagctacggacagtaagaacgtaacggg

SEQ ID NO: 386328 - DNA, 564 bp, Homo sapiens
  misc_feature: GZ8MTXP01CB48Q.22.86.H09.1.454.CMB.2.raw
  modified_base (273)..(273): a, c, t, g, unknown or other
  modified_base (332)..(332): a, c, t, g, unknown or other
  modified_base (394)..(394): a, c, t, g, unknown or other
  modified_base (537)..(537): a, c, t, g, unknown or other
  modified_base (544)..(544): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaaggggctgggagtgggtgcaattatatggtatgataggaaagtaaanaaagactatgtggactcgtgaaggccgatcacatctccagacgaacaactcaaagaacnctctacgtttccacaaatcgaacagacctgacgaggacgaggacacggcagtgtatacgtgngacgagagatcgacatgaactaagggaaactcgttttagaacgttcgtacgtacgggggaccaaaggggactaacgtcgggtacctaccgtctcttcacgccctaccaccgaacgggcccttacgttccgttcccttccccgnggtcccncccgtcgcctccgaacgccg

SEQ ID NO: 386329 - DNA, 579 bp, Homo sapiens
  misc_feature: GZ8MTXP01CEJR3.22.86.H09.1.454.CMB.2.raw
  modified_base (191)..(191): a, c, t, g, unknown or other
  modified_base (339)..(339): a, c, t, g, unknown or other
  modified_base (495)..(495): a, c, t, g, unknown or other
  modified_base (530)..(530): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtncagctggtggagtcgtgggggagcgtggtccagccgtggggacgtccctgagtactctcctgtgcagcgtctggatcaccttcagtggctagtggcatgcacgtggctccgcagggctccgggcaggggctggagtgggtgctaattntagtgtataagagtggaaagtaaataaagctagtggtaggaccttcggtaggaacgggccgtattccacgtatcctaccaaggacaccaaacgtccaaacgtaacctacttactttcgtttaccaaaccaaattacgaaacaacgcctaagacggnggacggaaggacgacggcaggttacgtatttacgngttacggaacgaaggtaacgacgtaccgaactaagaacggttaaaccgg

SEQ ID NO: 386330 - DNA, 600 bp, Homo sapiens
  misc_feature: GZ8MTXP01DEIKS.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccggcaaggggctgggagtgggtggacaattatatggtatgataggaaagtaaataaagactaatggtggactccggtaggaaagggccgattcaccatctaccagacgaacaactaccaaagaacactcttacgtttaccacaaatgaaacaagcctgaagaggacgaaggacacgggcagttgtattacgtgtgcgagagatcgaacagtacgaacgtaacggggaaattcgttttagattacgtcggtaggggaccaaggggactaacgtcggtcctaccgtctccgttcaacgccctaccaaccgtaaccgggcccttacgttccggttccccttcccccgtggcccgtcccctgcctaaccgaacgggaaccg

SEQ ID NO: 386331 - DNA, 589 bp, Homo sapiens
  misc_feature: GZ8MTXP01BHFLZ.22.86.H09.1.454.CMB.2.raw
  modified_base (310)..(310): a, c, t, g, unknown or other
  modified_base (368)..(368): a, c, t, g, unknown or other
tcagacatacgcgtcacgaccggtgctcgatttagtgctatagacttgggtttgggctgagcgtgggttttcctcgttagctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaaggggctgggagtgggtggctaattatagtggtatgataggaagtaataagatatgtgactcgtgaaggcgatcacatcncagagacaactcaagaacactctcttctacaatgacaagctgagagcgaggacacggntagtgtatgtgagagagagatacgacgagtacgaacggtaaggtaagttcggtttagacgtcgtacgggtacgggaacgaacgggtactaccggtcggtacctaccgttcctccgtaaccgtaccgttacccctacccgaccggtaccgggtcccttacccggttcccggttccccgttccccgcgggtccccgtcccgtcgacccgtccgaacggtcccg

SEQ ID NO: 386332 - DNA, 581 bp, Homo sapiens
  misc_feature: GZ8MTXP01EGQS2.22.86.H09.1.454.CMB.2.raw
  modified_base (256)..(256): a, c, t, g, unknown or other
  modified_base (417)..(417): a, c, t, g, unknown or other
  modified_base (433)..(433): a, c, t, g, unknown or other
  modified_base (452)..(452): a, c, t, g, unknown or other
  modified_base (522)..(522): a, c, t, g, unknown or other
  modified_base (524)..(524): a, c, t, g, unknown or other
  modified_base (541)..(541): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggcctcgggcaaggggctgggagtgggtgctaattanagtggtatgtaagtggaaagtaaataaagactaagtggtaggactccggtaggaaacgggtccgtatttccaacctatcctaccaagacgaactaacctaccaaagaaccacttcttcgtttccacaaatgaaacacgctgagacggacgaggacacggtnagttgtaatttacggngacgagagagtactacganagtacgaacgtaacggtagttacgttgtgtcgtacggtacggacgacgacgtacgtcgtctcgtctctcncncctccgaccgaccgccncgttccgttcccgtcccgtcgccgccgtcgctcgcgaacg

SEQ ID NO: 386333 - DNA, 616 bp, Homo sapiens
  misc_feature: GZ8MTXP01AHWZU.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggatcaccttcagtggctatggcatgcacgtggcctccggccgacgggccgtcccggggcgaaggggggctggggacggtggggtggacctaaatttagtagtagggtataggagtaagggtaaagtaaataaagactagtggtacggacgtcgtaggaacgggccgtattacaccatctaccaagacgacaaactaccaaagaaccgtacttcttcgtttacctacctaaatcgaaactacgacccgtaggaacggacgggaccggaaggaaccgaccgggacgttaaggttacgttaacgttacgttggttaggaacgaaggaagacgtacggaactaagttaacggtaaacccggg

SEQ ID NO: 386334 - DNA, 582 bp, Homo sapiens
  misc_feature: GZ8MTXP01DXNG9.22.86.H09.1.454.CMB.2.raw
  modified_base (258)..(258): a, c, t, g, unknown or other
  modified_base (300)..(300): a, c, t, g, unknown or other
  modified_base (527)..(527): a, c, t, g, unknown or other
  modified_base (534)..(534): a, c, t, g, unknown or other
  modified_base (550)..(550): a, c, t, g, unknown or other
  modified_base (565)..(565): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtntggtatctacctcagtggctatggcgatgcactggcgtcccnccgcggcgtcccgggcgaagggggcgtggaggtgggtggacaattatagtggtagtagatgggaaagtaaagtaaaacgtacgtaagtgggtacgggtaacttccggtagggaaacgggtccggaatttcaaacccagttctacccaagaacgaacaaacctaccaaacgaacaacttcttacgtttacaccaaaatgaactaagccgtagaggacggcggtaaacncgacggngttagtagtattacgngttggaagagaagancgataagttaacgtaag

SEQ ID NO: 386335 - DNA, 505 bp, Homo sapiens
  misc_feature: GZ8MTXP01BKY10.22.86.H09.1.454.CMB.2.raw
  modified_base (310)..(310): a, c, t, g, unknown or other
  modified_base (327)..(327): a, c, t, g, unknown or other
  modified_base (335)..(335): a, c, t, g, unknown or other
  modified_base (408)..(408): a, c, t, g, unknown or other
  modified_base (426)..(426): a, c, t, g, unknown or other
  modified_base (445)..(445): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagcctgggaggtccctgagactctcctgtgcagcgtctggatcaccttcagtggctatggcatgcactggctccgcaggctccgggnagggggctggagtgggngccattantggtatgatggaagtaataaagctagtgtgactcgtgaaggcgattcacatctcagagacactcaagacactntctttcaccaatgaaccngcctgagaggcgaaggacnccggtgagtgttaattacgttgttagaacggaggaagaagtcgactgttaagtaaccggg

SEQ ID NO: 386336 - DNA, 723 bp, Homo sapiens
  misc_feature: GZ8MTXP01AQQGV.22.86.H09.1.454.CMB.2.raw
  modified_base (252)..(252): a, c, t, g, unknown or other
  modified_base (272)..(272): a, c, t, g, unknown or other
  modified_base (318)..(318): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtcctgagctctctgtncagcgtctggattcaccttnagtggctagtggcatgcacgtggcctcccgcgaggccgtccggggngaagggggctggggacggttgggggtagactaaagtttagtagttgggtatggaagtagggaaaaaacgttaaataaggcttaagtgggtacggacctacgggtagggaaacggggccctaattcccgaactatcctacccgaaggaacgaaccaaaccgtaccaaacgtaaacctactttaccgttacggttttacccaaaccctaaagtacggaaaccacggtacccgttaggaaacggggacgggtaccggaacgggtacccgaacggggtccttaaaggggtttcgttaaacgtttaaccggttgggtacggaaccgggaagacggtaaacgttccgggaaaccgttaaggttacggggttaaaccccgggtttaaacgggggttaaaagtttttcccggg

SEQ ID NO: 386337 - DNA, 705 bp, Homo sapiens
  misc_feature: GZ8MTXP01CVF9F.22.86.H09.1.454.CMB.2.raw
  modified_base (617)..(617): a, c, t, g, unknown or other
  modified_base (649)..(649): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtggtggagtcgtgggggagcgtggtccagccgtgggaggtccctgagactctcctgtgcagcgtctggatcaccttcagtggctagtggcagtgcacgtggcctcccgccgaggccgtccgggacgaagggggctgggaggtggggtgaaccctaagtttatagtagggtataggtaagtaagggtaaaagttaaaacgtaaaaggtaccttaagttcgggtacgggtaacccgttaccggttagggaaaacgggggtcccgtaatttacccaaaccctaaagtttccctaaccgaaaggaacgaaaccctaaaccgttacccgaaaacgtaaacctcccgtttacggtttaactttacccaaacctaaaagtcggaaactacggtcctaagggaacggacgggacgaagggtaaacccgnggggtacttaaaggtttgtaaacgttttccgngggttacgaacggaagtaacgacgttacgaaccttaaggttaacggtaaaaccggg

SEQ ID NO: 386338 - DNA, 747 bp, Homo sapiens
  misc_feature: GZ8MTXP01E10IM.22.86.H09.1.454.CMB.2.raw
  modified_base (192)..(192): a, c, t, g, unknown or other
  modified_base (260)..(260): a, c, t, g, unknown or other
  modified_base (272)..(272): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccagccgtgggacgtccctgagactctcctgtgcagctntggatcaccttnagtggctagtggcagtgcctacgtcgggcctcccgccgacgggccgtacccgggggacgaaggggggtcttagggggaggttgggggtacggtaaccttaaagtttagtaaggttgggtaagtaaggtaaagttaaggggtaaaaagttaaaacgtaaaacgtacgttagttacgggtacgggtaacccgttacccgggtaagggtaaaccggggtacccgttaacttacccaaacccgtaacttacccgtaaccgaaacggaacgaaaccctaaacctaaacccgtaaaacgtaaacccgttaaccctttaccgtttaccgttttaacccaaaccctaaaagttaccgaaaccgtacggtcccgtaagggaacggaacggggaccggaaacgggaaccgaccgggattaggttaagttacgttacgttggttaggaacgaagtaagacgtacgaataagttaacggtaaacggg

SEQ ID NO: 386339 - DNA, 585 bp, Homo sapiens
  misc_feature: GZ8MTXP01DPYTO.22.86.H09.1.454.CMB.2.raw
  modified_base (276)..(276): a, c, t, g, unknown or other
  modified_base (378)..(378): a, c, t, g, unknown or other
  modified_base (417)..(417): a, c, t, g, unknown or other
tcagacatacgcgtcacgaccggtgctcgatttagtgctatagacttggggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggagtccctgagactctcctgtgcaggcgtctggattcaccttnagtggctatggcatgcactggctccgcaggctccgggcaagggggctgggagtggggtcgactaagttatagtgggtatgataggaaaaagttaaataacgntagtgtagactcggtaggacggcgatcacatctacaganacaactacaaagaactactcttcggtttactacctaaaatcgaaacacgccgtaggaaacggcggacggaacgggaccgaacgggaacgtaaggttagttaacgttacgtggtgacggagaagtaacgtacgaacgaagtacggaaacgttaacgggttaaagtttcg

SEQ ID NO: 386340 - DNA, 628 bp, Homo sapiens
  misc_feature: GZ8MTXP01EHG1Z.22.86.H09.1.454.CMB.2.raw
  modified_base (558)..(558): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggagcgtggtccagcctgggagtcctgagctctctgtgcagcgtctggattcaccttcagtggctatggcatgcactggcctccgccaggccgtccgggcgaagggggcctgggaggtggggtgactaaattatagtgggtataggaataggaaaaagttaaataaggtactaagtggtagggaccgtcgggtaggaacgggccgtaattccgaaccatacctaccaagtaacgacaaacctaccaaacgaacctacttacgttcggtttacctaacccgtaaaagtcgaaacgacgacccgttaggaacggacgggaccggaagggacctaacggggctaagggttnttaacgttacgtggttaggacgaggacgtaagtacggaacagtagaacggtaacgggttaaagtttccgg

SEQ ID NO: 386341 - DNA, 530 bp, Homo sapiens
  misc_feature: GZ8MTXP01EGY41.22.86.H09.1.454.CMB.2.raw
  modified_base (240)..(240): a, c, t, g, unknown or other
  modified_base (264)..(264): a, c, t, g, unknown or other
  modified_base (337)..(337): a, c, t, g, unknown or other
  modified_base (355)..(355): a, c, t, g, unknown or other
  modified_base (381)..(381): a, c, t, g, unknown or other
  modified_base (505)..(505): a, c, t, g, unknown or other
  modified_base (521)..(521): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaangcacccaggcaaacgccccagacncatcatttatgctgtcaataagcggccctcgacggggtcctgactcgcttctctggctcaagtctcggcaacncggccctccctacgaccntctcgtcgggctccgaggctagaagntgagctgattagttactgctgctctagttgcggagcgtacctacgtacgttgggtcgttcgggacggtaggaccaagtcgtcgaaccgtcttaggtcacgcccgaaggccttcgcccctggtcncgttctcggttccccnccttcgtcg

SEQ ID NO: 386342 - DNA, 514 bp, Homo sapiens
  misc_feature: GZ8MTXP01ENQOZ.22.86.H09.1.454.CMB.2.raw
  modified_base (276)..(276): a, c, t, g, unknown or other
  modified_base (305)..(305): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccagcctgggagtccctgagactctcctgtgcagcgtctggatcacttcagtggctanggcatgcactggctccgcaggctccgggnaagggggctggagtgggtgccaattatagtggtatgatggaagtaaataaagactatggtgactccgtgaaggccgattcactatctacagacgacaactacaaacgactactcttagttactaccaaagtcgaatagcctgagagggcgaagggacacgggcagtgtaattagttgttggaagagtaagatacgataagttgtaacgg

SEQ ID NO: 386343 - DNA, 810 bp, Homo sapiens
  misc_feature: GZ8MTXP01CJSKW.22.86.H09.1.454.CMB.2.raw
  modified_base (240)..(240): a, c, t, g, unknown or other
  modified_base (242)..(242): a, c, t, g, unknown or other
  modified_base (261)..(261): a, c, t, g, unknown or other
  modified_base (272)..(272): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttaataactatgtctctggtaccanancaccagcaacgccccagcncatctatttangctgtacaataacgcggcccctgacgggggtcccctgactcgtctttctcgtcggcctaccgaagtccgtacggaccaaacgacccggccccttccccgtacgtaaccctaacttcccttccgggtccggggtccttaccccggaacggggtccgttaaggaaacgtagttgggaaacgggtccttaggtaaattttacttaaccgttggtccttcggtaccttaccgttaggttttccggaccgggtaacgggggtcccgttacccgttaaccgttaccggggttttcgggggtaccgggtttccgggggaacccgggggtaacgggggtaacccgtaaacgggggtcccttaacccgggggtaaccccgggtttcccgttaaacggggggttacccaaacccggggaacccccggtaacggggttcccccgttcccccggggttaccccccccgtttccgggggttaaccctaacccgggttttccccttacccccgggtttcccccctaaccccccggtttccctaaaccccggg

SEQ ID NO: 386344 - DNA, 555 bp, Homo sapiens
  misc_feature: GZ8MTXP01BVOZ4.22.86.H09.1.454.CMB.2.raw
  modified_base (305)..(305): a, c, t, g, unknown or other
  modified_base (536)..(536): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcacttcagtgctatggcatgcactggctccgcaggctccgggnagggggctgggagtggggtgacctaattatagtggtatgatggaaagttaaataaagacttagtggtagggacctccggtaggaacggggccagttccacatcctacagacgacaactaccaaagaactacttcttacgtttacctaacctaaatcgaaacgacgtaccgtaggaggacgggacggaagggacgacggacgttagttagtattacgttgttgcgagaagancggataagttcggtaacgg

SEQ ID NO: 386345 - DNA, 682 bp, Homo sapiens
  misc_feature: GZ8MTXP01AOM6G.22.86.H09.1.454.CMB.2.raw
  modified_base (279)..(279): a, c, t, g, unknown or other
  modified_base (315)..(315): a, c, t, g, unknown or other
  modified_base (349)..(349): a, c, t, g, unknown or other
  modified_base (628)..(628): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcctgtgcagcgtctggatcacttcagtgctanggcatgcacgtggcctccgccgaggccgtccggggngaagggggctgggaggtggggtgacctaaagttntagtggtataggaagtaaggtaaagtaaactaaaagtcgttagttaggtacgggtaacccttaccgggtaggaaacggggtacccgtaagtttacccgaaccctaacgttacctacccgaaagaacgaaacccctaaaccttacccgaaaagtaacccgtacgtttacctttacgtttaacccttaacccgaaaagttcgaaaaccgtacggtacccgtagggaaaccggacggggaccggaaacgggaccgacgggacttagggttagttaattacgnggttggaaccgtaaggaacgtacgtaccggaactaagttaacgggtaaaccggg

SEQ ID NO: 386346 - DNA, 759 bp, Homo sapiens
  misc_feature: GZ8MTXP01D0R63.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgcactggcctccgcccgaggccgtccgggcaaggggctgggagtgggtgacctaattatatggtatgataggaaagtaaataaagactatgtggactcgtagaaggccgattcacatctaccagacgaacaactaccaaagaacactctcgtttacctacaaaatacgaacgaaacgcccgtgaacggaagggaccggaaacgggaaccacggggactaagttgttaaagtttaaccgtgggtaggaccggaaggtaaggaacgttaccgaaaccgtaagttacgggaaaccgttaaaccgggggtaaaagttcggttttttaggaacgtttccgttacggtaccgggggaccgtaaacgggggaacctaaccggtttagggtacccctaacccggttccgtttaccctttaacggaacccgttacccccgttaaccccgaaacccggaaaacccgggggtccccccttaaacggtttcccccggttcccccgtttcccccccggttcggccccgtcccccgttccgccccgttccccggaacgggtaaccccgg

SEQ ID NO: 386347 - DNA, 574 bp, Homo sapiens
  misc_feature: GZ8MTXP01EYULC.22.86.H09.1.454.CMB.2.raw
  modified_base (315)..(315): a, c, t, g, unknown or other
  modified_base (320)..(320): a, c, t, g, unknown or other
  modified_base (408)..(408): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaaggggctgggagtgggtggctaaattatatggtatgataggaaagtaaataaagactagtgtgactccgtgaacggcgatcacatcncaganacaactccaaagaacactctcgttcacaaatgaacaagctgagaggacgagacgacggctagtgtattacgtgagacgagagatcganagtagaacgtaacgggaaatcgtttgattcgacgtaggggaccaaggggaccagtcggtacctaccgtcttgttaacgccttccgaaaccgttaacgggccctaacgttccggttccccttccccgtgggcccctcccgttcgccgttacccgaagggccaacccg

SEQ ID NO: 386348 - DNA, 690 bp, Homo sapiens
  misc_feature: GZ8MTXP01DQ1GH.22.86.H09.1.454.CMB.2.raw
  modified_base (270)..(270): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctcctgtgcagcgtctgatcaccttnagtgctagtggcatgcacgtggcctcccggcaggccgtccgggggacgaagggggcttggggaggtggggtagacctaaatttagtagttgggtataggaagttaagggaaaagttaaaataaaacggtacgttaagttgggtacgggtaaaccctccggtaggaaacggggtcccaatttcccaacctactccgtaccaaggaacaaaccaaacctaccaaaacgaaaccttacctttactttacgtttaccctaaccaaaagttacgaaacccaacggtccctaaagggaacggaacggggaccgaaacgggaaaccgacggggtacttaagggttagtttaaacgtttacgttgggttaggaacgtaaaggaacggaacttacccgggaaactaaggtttaacgggtaaaacccggg

SEQ ID NO: 386349 - DNA, 538 bp, Homo sapiens
  misc_feature: GZ8MTXP01BICCT.22.86.H09.1.454.CMB.2.raw
  modified_base (331)..(331): a, c, t, g, unknown or other
  modified_base (357)..(357): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcgtggttttcctcgttgctctttaagaggtgtccagtgtcaggtgcagctggtggagtcgtgggggaggcgtggtccagccgtggggaggtccctgagactctcctgtgcagcgtctggattcaccttcagtggctatggcatgcactggctccgcaggctccgggnaggggctggagtgggtgcaagttaanatggtatgatggaaagtaataaagactatgtaggactccggtagaagggtctagtactaccactactccagagacgacaaccaacgaacactctcttacttaccaactaagacgacgacgcgaaggagggacggacggacggacggcgagttggtaattactgtgcgagtaagaagtaacg

SEQ ID NO: 386350 - DNA, 561 bp, Homo sapiens
  misc_feature: GZ8MTXP01ARI6A.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaagtaataaagactatgtgactcgtgaaggcgattcaccatctccagagacaactccaaagaacactctcgtttctaccaaatgaacaagcctgagaggcgaggacacggcagtgtatactggtgcgagagatcgacatgaacgtagggaaagtcgttttagattccgtcgtggggccaaagggacactggtaccaccgtctcttccacgccctccgacccgacggggccccacgttccgggttcccttcccccgtggcccgtcccctacgggttccctccggaacggaacccg

SEQ ID NO: 386351 - DNA, 687 bp, Homo sapiens
  misc_feature: GZ8MTXP01CJ7T6.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgcaggctccgggcaaggggctgggagtgggtgcaattatatggtatgataggaaagtaaataaagactatgtggactccgtgaaagggccattcacatctaccagacgacaactacaaagaactactcttacgttactacaaatgaaacaagcctaagaggacggacgacggacaacgggctagtgtattacgtgtgacgagagagtacgaactagtacgaacgtaacgggggtaaattcggttttaggaacttcgtacggtacgggggaacccgtaaaggggtacctaaccgggttcggtacccgtaacccggttccttccgtttaacccgaacgttcccccgttaacccgaaacccggtaaacccgggggtccccttaaccggtttccccgggttaccccgtttcccccccggtcgggtcccccgtcccccgttacggttccccgttaacccggttaacgggtaaccccgg

SEQ ID NO: 386352 - DNA, 644 bp, Homo sapiens
  misc_feature: GZ8MTXP01C7L98.22.86.H09.1.454.CMB.2.raw
  modified_base (606)..(606): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtccagccgtgggagtccctgagactctcctgtgcagcgtctggatcaccttcagtggctatggcatgcactggcctccggccagggccgtcccgggggacgaagggggctgggaggtggggtggacctaagttatagttggtaatgaagttaagggaaataaaattaaaggactagtagggtacggaaccgttccggtaggaacggggtaccgtacttaccaaccaactccctaccgaacgacgaaaccaacctacccgaaaacgtaaacctacttaccgttagtttaccctaacctaaaactcggaaacacgtaccctaggaagggacggacggaaacgggacgaccggacgttaaggttacgttaagttacgttggttacgnggaagaagaacgtacggaactaacgttaagtaaaccgg

SEQ ID NO: 386353 - DNA, 616 bp, Homo sapiens
  misc_feature: GZ8MTXP01CML1T.22.86.H09.1.454.CMB.2.raw
  modified_base (273)..(273): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggaggtccctgagctctcctgtgcagcgtctggactcaccttnagtggctatggcatgcactggcctcccggccgagggccgtcccgggggacgaaggggggctgggaggtggggtggaccctaattatagtggtataggaatgggaaattaaataaacgacttagtggtacgggacctccggtaggaacgggccgtattccaaccgtatcctaccgaagacgaaccaactaccaaacgaacgtacttacttcgttacctaacctaaatcgaaacacgtccgtaggaacgggacggacggaacggtaacgacgggtcgttaagttacgttaattacgttgttcggaacggaagaagtacgcgttacgtaagttaacggtaaaccgg

SEQ ID NO: 386354 - DNA, 573 bp, Homo sapiens
  misc_feature: GZ8MTXP01C275G.22.86.H09.1.454.CMB.2.raw
  modified_base (399)..(399): a, c, t, g, unknown or other
  modified_base (466)..(466): a, c, t, g, unknown or other
  modified_base (537)..(537): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgtactggctccgccaggcgtccgggcgaaggggcgtggaggtgggtggcaattatatggtatgagtaggaaagtaaataaagactatgtggactccgtgaagggccgattcaccatctcagagacaactaccaagaacactctgtttccctaccaaatgaaacacgaccctgaaggaggcggagggacacggcagtntattactgtgcgagagatcgacatgactaacgggaaagtctttggatcgtcgtggggaccaagggcngtcggctaccgttctcttcaacgtcccttccaaccgaacgggcccctattcccgggttcctttccccccgngggcccgtcccttcgcccttccgaacggaacgcccc

SEQ ID NO: 386355 - DNA, 559 bp, Homo sapiens
  misc_feature: GZ8MTXP01BYHL1.22.86.H09.1.454.CMB.2.raw
  modified_base (276)..(276): a, c, t, g, unknown or other
  modified_base (299)..(299): a, c, t, g, unknown or other
  modified_base (342)..(342): a, c, t, g, unknown or other
  modified_base (454)..(454): a, c, t, g, unknown or other
  modified_base (481)..(481): a, c, t, g, unknown or other
tcagacatacgcgtcacgaccggtgctcgatttagtgctatagacttggggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagctggtggagtcgtgggggaggcgtggtccagccgtgggacgtccctgagactctcctgngcagcgtctggacttcaccgttnagtgctagtggcatgcactggcctcccgcgaggccgtccgggngagggggctgggagtgggtgactaattatgtggtatggaatagggaaataataaacgcttagtgtggactcgagacgggtcattccacatccacagacgacaaactccaaanacctatctcgtttacacgtaaatgacngcgtaagaggacggcgaacggacgtacggcgttaggttacgttaatcgtggtacggagttagtaacgttaacgtaacg

SEQ ID NO: 386356 - DNA, 605 bp, Homo sapiens
  misc_feature: GZ8MTXP01DNA0M.22.86.H09.1.454.CMB.2.raw
  modified_base (239)..(239): a, c, t, g, unknown or other
  modified_base (261)..(261): a, c, t, g, unknown or other
  modified_base (264)..(264): a, c, t, g, unknown or other
  modified_base (324)..(324): a, c, t, g, unknown or other
  modified_base (373)..(373): a, c, t, g, unknown or other
  modified_base (402)..(402): a, c, t, g, unknown or other
  modified_base (421)..(421): a, c, t, g, unknown or other
  modified_base (428)..(428): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaanagcacccaggcaaacgccccanacncatctatttatgctgtacaataacgccggccctcgacggggtcccctgactcgtctttcncgtggcctcgaagtctcggaccaacgaccggtccctccctagaaccctntcctcgtcgggcctccgaggtctagaagntggagctagtattatactnctgtctntatttcgacgtacggtcgtaccttacgtacgttggggtcggttcgggacgggacggaccaagccgtacggtcccgttacgttaggtccacggccccgtaacgggcccgttcccggttcccccgttcgggtcctaaccgttcccgtccgtttccccctaaccccgttcccgtaacccg

SEQ ID NO: 386357 - DNA, 555 bp, Homo sapiens
  misc_feature: GZ8MTXP01ATS7Y.22.86.H09.1.454.CMB.2.raw
  modified_base (243)..(243): a, c, t, g, unknown or other
  modified_base (251)..(251): a, c, t, g, unknown or other
  modified_base (303)..(303): a, c, t, g, unknown or other
  modified_base (308)..(308): a, c, t, g, unknown or other
  modified_base (364)..(364): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggngcaattanatggtatgatggaaataataaagatatgtgactcgtgaaggccatcacatcncaganacaactcaaagacactctcgttcacaatcgaacaagctgagagacgagacacgggntagtgtattacgtagtgacggagagactacgaacagtacgaacgtaacgggtaaatcgttttagacttcgtacggtggggaccaaagggctacgtcgtacctaccgtctctccaacgcccgtacccaccgacggcccttacgttcccgttcccgttccccgcggcccgtccctcgttcctccgaacgcccg

SEQ ID NO: 386358 - DNA, 526 bp, Homo sapiens
  misc_feature: GZ8MTXP01BUJXP.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcacttcagtgctatggcatgcacgtggcctccgcaggctccggggcaagggggctgggagtggggtgcaattatagtggtatgatggaagtaaataaagactagtgtggactccgtagaggcgatcacatctaccagacgacaactacaagacactctcgttactaccaaatacgaacaacgcctagacgaggcggaaggacgacggggacttaggtacgtattacgttgttcggcgagaagagtacgactaagttcgtaacgg

SEQ ID NO: 386359 - DNA, 655 bp, Homo sapiens
  misc_feature: GZ8MTXP01AKLJG.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctcctgtgcagcgtctggatccaccttcagtggctatggcatgcactggctccgcaggctcccggaggacggagggcgtgggagggtggggtgacttaagttagtagtaggtaataggtaagtaaggtaaagtaaagtaaacgtattaggtggtacggtaccgtacggtaacgggaacgggtcctacttacccaacctacgttaccaccgaacggtaacaaaccctaaaccctaaccgaaaacggtaacccttacctttaccgtttacctttaacctaaaccctaaagtaccgaaacgtccgtaccgtaaggacggggacggaacgggaacggaaccggaccggttagtaaggttagttaccgttacgttggaacggaggaagaagtacgttacgaacgttaaggtaaccgg

SEQ ID NO: 386360 - DNA, 608 bp, Homo sapiens
  misc_feature: GZ8MTXP01DESTC.22.86.H09.1.454.CMB.2.raw
  modified_base (404)..(404): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgcaggctccgggcaaggggctgggaggtggggtggactaattatatggtatgaataggaaagtaataaagactatgtggactcgtagaagggccgattcaccatctccagacgaacaactccaaagaacactctcgtttcacaatcgaacacgcctgagagggacgaggacacggcagtgtattacgngtgcgaagagatcgaacagtagaacgtaacggggtaaatcgttttaggacttacgtcgacgggggtaaccaaggggtactaacgttcgggtcctacccggtcttccgttaacacgccctacccgaaccgtaacgggcccttacgttccgggttaccccttcccccgtggggcccgtccccgtcggccctccgaacgggtccccg

SEQ ID NO: 386361 - DNA, 736 bp, Homo sapiens
  misc_feature: GZ8MTXP01CR0WV.22.86.H09.1.454.CMB.2.raw
  modified_base (189)..(189): a, c, t, g, unknown or other
  modified_base (697)..(697): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggcctccgccgaggccgtccggggacgaagggggctgggaggtggggtggactaattatagtggtatagaagtaggaaagtaaataaagactagtggtaggaccgtcggtaggaaacgggccgtaattaccgaacctatacctaccgaagaacgtaaaccaaacctaccaaaagtaaacctacttctttaccgtttacctaaaccaaatacgaaacaacgtacccgtaaggaaacgggaacgggacggaacggaacgaacgggactaaggttagtttaacgttaacggtggtacggacggaaggaagtacgtaccgaataagtacgaaacgtaacggggtaaatttcgttttagaacgttccgtcggtacggggaaccaaaggggtacctaacggttcggtacccaccgttccttcttaaccgaccgccccgttacccgaaaccggtaaaccgggtcccttaacggttccccggttccccttcccccgngggtcccctccccgttgccccgtaaccgaaggaaccccg

SEQ ID NO: 386362 - DNA, 604 bp, Homo sapiens
  misc_feature: GZ8MTXP01B1FQ6.22.86.H09.1.454.CMB.2.raw
  modified_base (228)..(228): a, c, t, g, unknown or other
  modified_base (406)..(406): a, c, t, g, unknown or other
  modified_base (414)..(414): a, c, t, g, unknown or other
  modified_base (577)..(577): a, c, t, g, unknown or other
  modified_base (589)..(589): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggcgtccgggnaaggggctgggagtgggtgactaattatagtggtatgataggaaataaataaagactagtgtggactccgtaggaaggccgattcaccatctaccagacgaacaactaccaaagaacactcttacgtttaccacaaagtcgaacaacgcctggagacgggcgaaggacacggctagtntattacgngtgacgagagatacgatagtacgaacgtaaggggaattcgtttacgaattcgacggtacggggaccctaaaggggactacggttcggtacctacccgttctcgtaaccgacgccctacccgaccgaacgggtccccttacggttcccgttccccgttccccgnggcccctcccgngccctccgaaggccc

SEQ ID NO: 386363 - DNA, 549 bp, Homo sapiens
  misc_feature: GZ8MTXP01D7RTG.22.86.H09.1.454.CMB.2.raw
  modified_base (523)..(523): a, c, t, g, unknown or other
  modified_base (529)..(529): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtgcaattatatggtatgatggaagtaataaagactatgtggactccgtgaaggccgattcaccatctccagagacaactccaagaacactctcgtttcacaaatcgaacagcctgagaggcgagacacgggcagtgtattactgtgcgagagatcgacatgaacgtaagggaaatcgttttagattcgtcgtaggggcctaaaggggctaacgtggtcctaccggtctcttcacgccctaccgaacgaacgggccccttagttccggttcccttccccgnggcccncccgtgcctcgaaggaaccg

SEQ ID NO: 386364 - DNA, 575 bp, Homo sapiens
  misc_feature: GZ8MTXP01DSWVO.22.86.H09.1.454.CMB.2.raw
  modified_base (398)..(398): a, c, t, g, unknown or other
  modified_base (408)..(408): a, c, t, g, unknown or other
  modified_base (486)..(486): a, c, t, g, unknown or other
  modified_base (502)..(502): a, c, t, g, unknown or other
  modified_base (557)..(557): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtgacaattatatggtatgataggaaagtaataaagactatgtagactcgtgaagggccgattcacatctaccagacgaacaactacaaagaacactcttcgttactacaaatcgaaacaagcctgaagaggacgaggacgacggcagtgtattacngtgacgaganactacgacagtagaaccgtaagggaaattcgttttgaagttcctacggtggggaacccaagggctaaccggtgtaccnccgttactcttcgacncctaccgaacgaacgggcccttacgttcccgttcccttccccgtggccctcccgngccgtccgaagggaaccg

SEQ ID NO: 386365 - DNA, 687 bp, Homo sapiens
  misc_feature: GZ8MTXP01CH57R.22.86.H09.1.454.CMB.2.raw
  modified_base (274)..(274): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggaggtcccctgagtactctcctgtgcagcgtctggatcaccttnagtggctatggcatgcacgtggcctcccggccgagggccgtcccgggggcgaaggggggtctaggggaggttggggtaggaccctaaagtttagtagttgggttaatagggtaagttaaggggaaaacgtttaaaagtaaaaggttacttaggttagggtacgggtacccgttacccggtagggaaacggggtccgtacgttacccacctaacttcctaccgaacgaacgaaccaaactaccgaaacgtaaccgtacttcgtttacgtttaccctaacctaaaacgttacggaaacctacgacccgtaggaaggacgggcggaaacggacgacgggacgttaggttagttaacgttaccggttggttcgggaacggaggaagtacgtacggactaagttaacggtaaaccggg

SEQ ID NO: 386366 - DNA, 583 bp, Homo sapiens
  misc_feature: GZ8MTXP01AN4FS.22.86.H09.1.454.CMB.2.raw
  modified_base (215)..(215): a, c, t, g, unknown or other
  modified_base (228)..(228): a, c, t, g, unknown or other
  modified_base (327)..(327): a, c, t, g, unknown or other
  modified_base (366)..(366): a, c, t, g, unknown or other
tcagacatacgcgtcacgaccggtgctcgatttagtgctatagacttgggtttggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactntgtctctgacaangcaccaggcaaagccccagactcatcatttatgctgtcaataacgccggccctcgaggggtcccctgactcgcttctctggctccaagtctggcaaccncggctccctgaccaatctcgtgggctccgaggctgaacntgaggctagattattactgctgctcattgctacggccggtcctacgtacgttggggttcgttcgggacgggtacgggaacccgtaaggccgttacggacccggttccgtaacggggtccacgggaccccgaaaggggtccctccggttcccccccgttcgggttaccctccgtccttccggtttccccccaccccgttccctaaccgaaccggtccg

SEQ ID NO: 386367 - DNA, 619 bp, Homo sapiens
  misc_feature: GZ8MTXP01A52YV.22.86.H09.1.454.CMB.2.raw
  modified_base (431)..(431): a, c, t, g, unknown or other
  modified_base (453)..(453): a, c, t, g, unknown or other
  modified_base (591)..(591): a, c, t, g, unknown or other
  modified_base (597)..(597): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggctccgggcaaggggctgggaggtggggtggactaattatagtggtatgagtaggaaagtaaataaagtactaagtggtaggacgtccggtaggaaagggccgtattccaccatctaccaagacgaacaactaccaaagaactactacttacgttacctacaaatcgaaacaacgcctggagagggcgaggacacggctagtagtattacgnggtgacggagaacgatacgaanagtacgaaacgtaaggggtaaatcgttttaggacttcgtacggtggggacccgaagggtaccacggtcggtacctacccgttctctaaccgacgccctaccgaacgaccggtcccttacgttccgttcccttccccgnggcccnccctggccctcgaaggtaaccc

SEQ ID NO: 386368 - DNA, 559 bp, Homo sapiens
  misc_feature: GZ8MTXP01B5STW.22.86.H09.1.454.CMB.2.raw
  modified_base (406)..(406): a, c, t, g, unknown or other
  modified_base (536)..(536): a, c, t, g, unknown or other
  modified_base (541)..(541): a, c, t, g, unknown or other
  modified_base (553)..(553): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcgtccgggcgaaggggctgggaggtggggtggactaaatttatagtggtatgaataggaaagtaaataaagactaagtggtggactccgtaggaaggccgatcacatctcagagacaactaccaaagaactactcttcgttactacaaatgaacagcctgagaggcgagacacgcagtgtatacngtgcgagagatacgacagtagaacgtaagggaaattcgtttagatcgtacggtacggggaccaaggggacacgtcgtccaccgtctcgtcacgccctaccaccgaacggccacgttccgcccttccccgngcccncctcgcctccgngaaccg

SEQ ID NO: 386369 - DNA, 565 bp, Homo sapiens
  misc_feature: GZ8MTXP01BXB01.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaaggggctgggagtggggtggcaattatatggtatgataggaaagtaaataaagactatggtggactccgtagaagggcgattcaccatctccagagacaactcaaagacactctcgttcacaaatgaacaagcctgagaggcgaggacacggcagtgtattactgtgcgagagatcgacatagaacgtaacggggaaattcgttttagacgttccgtcggtacggggaccgaaaggggactacgtcggtaccaccgttctcttcgacgcctacccgacgaacgggcccacgttccggttcccttccccgtggcccgtcccgtgcctccgaaggccg

SEQ ID NO: 386370 - DNA, 663 bp, Homo sapiens
  misc_feature: GZ8MTXP01CRPWF.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaagggggctgggagtggggtggactaattatatggtatgatggaaagtaaataaagactatgtggactccgtgaagggccgattcaccatctacagagaacaactaccaaagaacactactcgtttaccacaaatgaacaagccctgaggagggcggaggacacggacgagtcgtattactgtgacgaggagtatcgaacagttacgaacgtaacgggtaaagttcgttttaggaactttcgttaccgggtacgggggtaaccgaaacggggacctaaccggttcgggtacccgtacccggttccttccttaaccgaaccgttcccgtaacccgacccgtaaaaccgggggtccccttaacggttcccggtttccccttcccccggtcgggtcccgtccccgtcggttcccgtaacccggaacgggtaaccccgg

SEQ ID NO: 386371 - DNA, 656 bp, Homo sapiens
  misc_feature: GZ8MTXP01C6IVP.22.86.H09.1.454.CMB.2.raw
  modified_base (241)..(241): a, c, t, g, unknown or other
  modified_base (265)..(265): a, c, t, g, unknown or other
  modified_base (275)..(275): a, c, t, g, unknown or other
  modified_base (324)..(324): a, c, t, g, unknown or other
  modified_base (363)..(363): a, c, t, g, unknown or other
  modified_base (392)..(392): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttaataactatgtctctgtaccaanagcaccaggcaaacgccccagacncatcatttangctgtacaagtaacgccggcccctcgacggggtccctgactcgtcttcnctggcctcagtctcggacacgacggcctccctgaccctntccgtctcggggcctccgaggctagaagntggaggtctgtaattactttactgtcttcgcttacgtagtttcggcgtacgggtcccgtaccgttaaccgtcgtttcgggggttcgttacggggaccgggtaacgggaacccgtaaggtcccgtacggtaacccggttacccgttacgggttacccgaccggtaaaaccccgacgggttccccgttcccggttccccccccggttcgggtacccttcccgttcccttaccccgtttccccctaaccccgttccctttaacccgg

SEQ ID NO: 386372 - DNA, 773 bp, Homo sapiens
  misc_feature: GZ8MTXP01DFAYR.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcaccttcagtggctatggcatgcactggcctccgccgaggccgtcccgggggacgaaggggggtctgggaggtggggtaggaccctaaagtttagtagttagggtaattaaggaagttaaggggaaaagttaaaagtaaaaacggtactttaagtacgggtacgggaaacccgttcccggttagggaaacggggtaccccgtaatttacccgaaaccctaacgttcccgtaccccgaaaggaaacgaaacccctaaaaccgttaaccccaaaaaacggaaacccgttaaccctttaccgtttaacgttttaaccccgtaaccctaaaaaactttcgaaaaccgttaaacggccccgttaagggaaagggaacggggaaccggaaacggggaaacccggaaccggggtaccgttaaggggtttaaccgtttaaagttttaccggttgggttaccggtaacgggaaaggtaacgaacgttacgggaacctaagttaaccgggttaaaaccggg

SEQ ID NO: 386373 - DNA, 649 bp, Homo sapiens
  misc_feature: GZ8MTXP01BJZ2T.22.86.H09.1.454.CMB.2.raw
  modified_base (342)..(342): a, c, t, g, unknown or other
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtggggtgcaattatatggtatgatgggaaagtaaataaagactatggtggactccgtggaaagggccgattcaccatctccagagacaactccaaagaacnctcttgttaccacaaatgaacaacgcctgagagggacgaggacacgggcagtntattactggtgcgagagactcgaacagtacggaacgtaacggggtaaagttcgtttttagggaacttccgttcgggtacgggggaacccgtaaagggggacctaacgtcgggtcctaacccggttctccggttccaaccggttcccctacccaaccgggaaccggggtaccccttacgttccccgggttccccgtttaaccccccgtggggtccccgtcccccgttaggccccgttcccggaaacgggtccccg

SEQ ID NO: 386374 - DNA, 615 bp, Homo sapiens
  misc_feature: GZ8MTXP01CBKIM.22.86.H09.1.454.CMB.2.raw
  modified_base (268)..(268): a, c, t, g, unknown or other
  modified_base (305)..(305): a, c, t, g, unknown or other
  modified_base (337)..(337): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttggctgagctgggttttcctcgttgctcttttaagaggtgtccagtgtcaggtgcagctggtggagtcgtgggggagcgtggtccagccgtgggagtccctgagactctcctgtgcagcgtctggatcacttnagtgctatggcatgcactggctccgcaggctccgggnagggggctgggagtggggtgacctaagtttanagttgggtatggaagtgggaaaagttaaactaaaaggctaagttgggtacgggaacgttccggtaggaacggggtccgattccacatcctaccgaagacgaacctaaacctaccaaacggtaaacctaacttccgttacgtttacctaaccctaaaattacggaaactaacggccctaggaacggacggacggaacggaaccacggggtacttaaggttacggttacttaacgttggttcgaacggagaacgtataccggataagttcgtaaaccggg

SEQ ID NO: 386375 - DNA, 779 bp, Homo sapiens
  misc_feature: GZ8MTXP01DAALZ.22.86.H09.1.454.CMB.2.raw
  modified_base (206)..(206): a, c, t, g, unknown or other
  modified_base (239)..(239): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtnatgttggtgttataactatgtctctgtaccaanagcaccaggcaaagccccagactcatcatttatgctgtacaagtaacgccggcccctcgacgggggtcccctgactcgtctttctctggctcaagtctcggaccaacgaccggtccctaccccgtgaacccgttcgtcgttcggggaccttcccgaagggtccgttaggaagggtaattgggaaacgggtcccttggtaaattttacgttaaaccgtttcggtaccttaaaccttaccgtaaatttaacgtcgggtacccgaaggggggtaccccggtaaccgtaaaccgtttccgggtttgggggttaacgttcccgggggacgggttaaaacggggaccccgtaaagggtccgttaaccgggtaaccccgggttaaccgttaaacgggggttcccgaaacccggacccccggtaaaagggggtcccctttaccccgggttccccccggttcccggggttaaccctaaccccgttttccggttcccccggtttcccccccggttaaccccgtttcccccgtttaacggtaacccccggg

SEQ ID NO: 386376 - DNA, 581 bp, Homo sapiens
  misc_feature: GZ8MTXP01EG9UD.22.86.H09.1.454.CMB.2.raw
  modified_base (256)..(256): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaagggggctgggagtgggtggcaattanatggtatgatggaagtaataaagactatgtggactccgtgaaagggccgattcaccatctccagacgacaactccaagacactctcgttctacaaatgaacaagcctgagaggacgaggacacggcagtgtattactgtgcgagtagatcgacatgactagggaaatcgtttgatctcgtaggggcccaaggggcaacgtggtccaccggttctctcgacgttcccctaccgaccgtaaacggggtccccttaacgttcccgggttcccgtttcccccccgtggggcccgtcccccgttggcccttaaccccgaagggaaccccg

SEQ ID NO: 386377 - DNA, 582 bp, Homo sapiens
  misc_feature: GZ8MTXP01EQDNP.22.86.H09.1.454.CMB.2.raw
  modified_base (552)..(552): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaagtaataaagactatgtggactcgtgaaggccgattcaccatctccagagacaactcaaagaacactctcgttcacaaatgaacaagcctgagaggcgagacacgggcagtgtattacgtgtgcgagagatcgacagtgaacgtaacgggaaagtcgtttagattcgtacgtcggggaccaaacggggactacgtcggtccacccggttctcttcgacgttccctaccgaacccgaacggggccccttacgttcccgggttcccctttcccccgtcgggtcccnccccgttcgcccgttccgaacgggaacccg

SEQ ID NO: 386378 - DNA, 540 bp, Homo sapiens
  misc_feature: GZ8MTXP01EN1Z8.22.86.H09.1.454.CMB.2.raw
  modified_base (227)..(227): a, c, t, g, unknown or other
  modified_base (253)..(253): a, c, t, g, unknown or other
  modified_base (387)..(387): a, c, t, g, unknown or other
  modified_base (390)..(390): a, c, t, g, unknown or other
  modified_base (406)..(406): a, c, t, g, unknown or other
  modified_base (517)..(517): a, c, t, g, unknown or other
  modified_base (521)..(521): a, c, t, g, unknown or other
  modified_base (534)..(534): a, c, t, g, unknown or other
tcagacatacgcgtcacgaccggtgctcgatttagtgctatagacttggggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcatggctccgccaggctcgggnaaggggctggagtgggtggcaattanatggtatgatggaaagtaaataaagactaatgtaggactcgtgaaaggccgattcacatctccagagacaactcaagaacactctcgttctacaaatgaacagcctgagaggcgaagacacggcatgtattacngtncgagagatacgacgangaactaagggaaatcgtttagatctacgtggggaccaagggacacgtggtacctaccgtctcgttaacacgccctacccacgaaacggcccagttccggttccttccccgngccnccctcgcctccgnggaacc

SEQ ID NO: 386379 - DNA, 556 bp, Homo sapiens
  misc_feature: GZ8MTXP01DH7E4.22.86.H09.1.454.CMB.2.raw
  modified_base (537)..(537): a, c, t, g, unknown or other
  modified_base (541)..(541): a, c, t, g, unknown or other
  modified_base (552)..(552): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaaataaagactaatgtggactccgtgaagggccgatcacatctccagagacaactaccaaagaacactcttcgtttaccacaaatgaaacaacgcctggagagggacgaggacacgggcagtgtattactggtgcgagagatcgaacagtagaactaacggggaaatcgttttagattcgtacggtcggggaccaaggggacacgtcggtccaccgtctcgttcacgcctaccacgaacgggcccagttcggttccctccccgngccnccctgctccgnggcc

SEQ ID NO: 386380 - DNA, 511 bp, Homo sapiens
  misc_feature: GZ8MTXP01EYNRQ.22.86.H09.1.454.CMB.2.raw
  modified_base (300)..(300): a, c, t, g, unknown or other
  modified_base (335)..(335): a, c, t, g, unknown or other
  modified_base (409)..(409): a, c, t, g, unknown or other
  modified_base (428)..(428): a, c, t, g, unknown or other
  modified_base (488)..(488): a, c, t, g, unknown or other
  modified_base (497)..(497): a, c, t, g, unknown or other
  modified_base (500)..(500): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgcaggtgcagctggtggagtcgtggggaggcgtggtccagcctggggagtccctgagactctcctgtgcagcgtctggatcacttcagtggctatggcatgcactggctccgcaggcnccggggcaagggggctgggagtgggtggccaattntagtgggtatagatggaaagtaataaagactatggtcggatcccgtgaagggccgagttcaccacatctccagngaacactcaacggaacacnctagttctaccaatagaacaagcctagagaggcggaggacgacggcgaggtttagttacngtgcgaagngancgaacgaagtg

SEQ ID NO: 386381 - DNA, 512 bp, Homo sapiens
  misc_feature: GZ8MTXP01CD89Y.22.86.H09.1.454.CMB.2.raw
  modified_base (270)..(270): a, c, t, g, unknown or other
  modified_base (331)..(331): a, c, t, g, unknown or other
  modified_base (341)..(341): a, c, t, g, unknown or other
  modified_base (348)..(348): a, c, t, g, unknown or other
  modified_base (362)..(362): a, c, t, g, unknown or other
  modified_base (407)..(407): a, c, t, g, unknown or other
  modified_base (428)..(428): a, c, t, g, unknown or other
  modified_base (470)..(470): a, c, t, g, unknown or other
  modified_base (487)..(487): a, c, t, g, unknown or other
  modified_base (489)..(489): a, c, t, g, unknown or other
  modified_base (493)..(493): a, c, t, g, unknown or other
  modified_base (497)..(497): a, c, t, g, unknown or other
  modified_base (505)..(505): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggagtccctgagactctcctgtgcagcgtctggatcaccttnagtgctatggcatgcactggcctccgccaggctccgggggcaagggggctgggagtggggngaccaattanatggtangatgggaaataaanaaagctatggtagactcgtaggaaggccgattcacatctacaganacaactcaaagaacactcgtnttactacaaatcgaacagcctagagaggcgaaggacacgggnagttagtattacgttgngngagngtancgataagngtaacgg

SEQ ID NO: 386382 - DNA, 663 bp, Homo sapiens
  misc_feature: GZ8MTXP01DL648.22.86.H09.1.454.CMB.2.raw
  modified_base (316)..(316): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagtactctcctgtgcagcgtctggatcaccttcagtggctatggcatgcacgtggcctccgccgaggcgtcccggggngaagggggctgggaggtggggtggacctaatttagtagttggtaataggtaagtgggtaaaagttaaacgtaaaaaggacttaagtgggttacgggaccgttccgggtaggaaacgggtccgtaacttccaaccctattacctacccaagggaacgaaaccaaaccgtaaccaaacgtaaacctaaccttcttacgtttacctaaccaaaacttcgaaacaacgcctaggaggacgggacggaacggaacgttaccgggacgttaggttacgttaaagtttccgttggttacggaacgggtaaaggaacgtaagccggttaaactaagttaacggttaaaaccgggg

SEQ ID NO: 386383 - DNA, 612 bp, Homo sapiens
  misc_feature: GZ8MTXP01DXOOY.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaaggggctgggagtgggtgcaattatatggtatgatggaaagtaataaagactatgtggactcgtgaaaggccgattcaccatctccagacgacaactcaagaacactctgttcacaaatgaacagcctgagaggcgaggacacggcagtgtattacgtgtgcgagagatcgacagtacgaacgtaacgggaaagttcgttttaggaatttccgtacggtacgggggacccgaaaggggtacctaaaccggttcgggtaccctaacccggttcttccttaaccgaacggttcccttacccgaaaccggaaacgggtccccttaacgttcccgggttccccttcccccgtcggcccgtcccctggccctaaccgaacggtaacccg

SEQ ID NO: 386384 - DNA, 614 bp, Homo sapiens
  misc_feature: GZ8MTXP01B0JJS.22.86.H09.1.454.CMB.2.raw
  modified_base (354)..(354): a, c, t, g, unknown or other
  modified_base (392)..(392): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtgcaattatatggtatgataggaataaataaagactatgtggactccgtagaaagggccgatcacatctccagacgacaactaccaaagaacactctcgtttcacaaatanaacagcctgagagggcgagacacggcagtgtattacgngtgacgagagacgtcgaacagtagaacgtaacgggtaaagtcgttttagacttacgtcggtacggggccgaaaggggactaaccggttcggtaccctacccggttctccgttaaccgaccgttccctacccgaacccggaaacgggtccccttaacggttccccggttccccttcccccgtcggcccgtcccctcggttccctaacccgaacgggtaacccg

SEQ ID NO: 386385 - DNA, 697 bp, Homo sapiens
  misc_feature: GZ8MTXP01A4YU0.22.86.H09.1.454.CMB.2.raw
  modified_base (463)..(463): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccgaggccgtccgggcgaaggggcgtgggaggtggggtggactaattagtagtggtatggagtaggaaagtaaagtaaagactagtggtaggacctccggtaggaacgggccgtattccaaccactcctacccaagacgaaccaaacctaccaaagaacctacttcttaccgtttacctaaccaaagtacgaaacaacgcctggaagacgggacggaacgggacgacgggactaggtatacgttacgnggtgacggagagactacgaacagtacgaacgtaacgggtaaacttggttttacgaagtttccgacgggtacggggaccgaagggtaccgtacggtcggtccctaaccgttccttccgttcaaccgttcccctacccgaaaccgaacccggggtcccttaccggttccccggttcccctttcccccggcgggtccccgtccccgtcggttacccctaaccggaacggtaaccccg

SEQ ID NO: 386386 - DNA, 575 bp, Homo sapiens
  misc_feature: GZ8MTXP01BI2RY.22.86.H09.1.454.CMB.2.raw
  modified_base (554)..(554): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaaataaagactaatgtggactccgtggaaggccgattcaccatctccagacgacaactaccaaagaacactctcgtttctacaaatgaaacaagcctgagagggacgagacgacggcagtgtatactgtgcgagagatcgacatacgaacgtaacgggaaagtcgttttaggaacttcgtcgtagggggacccgtaaagggacctaacgtcggtccaccgttctcttccacgcctcccacgtaacggcccttacgttccggttccctccccctgggtcccncccgtcgcctccgaagggccc

SEQ ID NO: 386387 - DNA, 530 bp, Homo sapiens
  misc_feature: GZ8MTXP01ARIXI.22.86.H09.1.454.CMB.2.raw
  modified_base (307)..(307): a, c, t, g, unknown or other
  modified_base (488)..(488): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggatcaccttcagtggctatggcatgcactggctccgcaggcgtccgggngaagggggctggagtggggtgacctaattatagtggtatgatggaaagtaaataaagactagtggtgactcggtagaacgggcatcacatcacagacgacaactaccaagaactacttctgttacctaccaaatcgaacacgcctaggacgaggcgaaggacacggacagtgtaattacgnggttgaacggagaagacgtacgaactaagttcggtaaacggg

SEQ ID NO: 386388 - DNA, 730 bp, Homo sapiens
  misc_feature: GZ8MTXP01AFVVF.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacgctctcctgtgcagcgtctggatcaccttcaggtggctagtggcagtgcacgtcggccctcccggccgacggccgtcccgggggacgtaaggggggcctagggggaggtgggggtagaccctaaagtttagtagttaggtagtaaggaagttaagggtaaaagtaaacgtaaaagggtacttaaggttaggggtacggtaaccggttacccggtaggggaaaccggggtccccgtaatttacccaaccgtacttaccctaccgaaacggaacgaaaccccaaacttaccccgaaaacgtaacccgtactttaccgtttacgtttaccctaaaccctaaagtacggaaaccgtaacgcccgtagggaacggacggggccggaaacgggaaccgaccgggtacgttaaaggttcgttaaagtttccggttagggttaccgaacgggaaagaagggaactaccggaacctaaggttaacggtaaccgggg

SEQ ID NO: 386389 - DNA, 641 bp, Homo sapiens
  misc_feature: GZ8MTXP01D2SKV.22.86.H09.1.454.CMB.2.raw
  modified_base (234)..(234): a, c, t, g, unknown or other
  modified_base (308)..(308): a, c, t, g, unknown or other
  modified_base (600)..(600): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtgggggagcgtggtccagcctgggagtccngagctctcctgtgcagcgtctggatcaccttcagtgctatggcatgcactggcctccgcaggccgtcccggganaagggggctgggagtggggtgacctaattatgtggtatagatggaaagtaaataaaaggctagtgggtaggaaccttccggtaggaacgggtccgtaatttccaacctacgttcctacccgaaggaacgaaaccaacctaccaaaacgaaacctaaccttcgttacgttttaccaaccctaaaacgttacgaaaccgtacgcccgttaggaacggacggggacgggaaacgggtaccgaccgggtacttaacgggttacgttaatttaccgttggttacgggaacgaaaggnggtaacgttacggaaccttaagttaacggtaaaacccgggg

SEQ ID NO: 386390 - DNA, 699 bp, Homo sapiens
  misc_feature: GZ8MTXP01C1SOX.22.86.H09.1.454.CMB.2.raw
  modified_base (502)..(502): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgagtaggaaagtaaataaagactagtggtaggaccgtcgtaggaacgggccgtacttaccaaccactacctacgagaacgaaccaacctaccaaacgaaacctaccttacgtttaccgtttacctaaacctaaagtaacgaaacgaaacgtaccgtggaaaggacgggacgggaacgggaacgacggacgtaggttagttaacgttacgtggtacggacgaaaggaagtacgtaccgaanagttaacggaacgttaaagggggtaaactttcgttttaacgacgtttccgtacgggtacggggaacccgaaagggtcctaacggtcgtaccctaccgtcttcttaacgacgccctacccgaccgtaaaccgggtcccttacggttcccgttccccttccccggcggccctacccgtcggccctaaccgaaggaaccc

SEQ ID NO: 386391 - DNA, 564 bp, Homo sapiens
  misc_feature: GZ8MTXP01A25RY.22.86.H09.1.454.CMB.2.raw
tcagacatacgcgtcacgaccggtgctcgatttagtgctatagacttgggtttgggctgatctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctggagtggggtggcaattatatggtatgatggaagtaataaagactatgtggactccgtgaaagggccgattcaccatctccagagacaactccaagaacactctcgtttcctcaaatgaacaagcctgagagggcgaggacacggcagtgtattactgtgcgagagatcgaacagtgaacgtacggggaaagtcgttttaggaattcgtacgtcgggggacccaaaggggaccacgtggtccaccggtctccgttcagcctacccaccgaacgggcccagttccggttcccttcccccgtggcccgccctgccctcgaacggaaccg

SEQ ID NO: 386392 - DNA, 559 bp, Homo sapiens
  misc_feature: GZ8MTXP01B3BVC.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgataggaaagtaaataaagactaatggtggactccgtggaaagggccgattcaccatctccagacgaacaactaccaaagaaccactctcgtttcaccaaatcgaacaacgcctgagaggcgaggacacggcagtgtattactgtgcgagagatacgacatagaacgtaacggggtaaagtcgttttgattacgtcgtcggggaccaggggacacgtgtccaccgtctcttcacttccctaccaccgaacggccacgttccgttcctccccgtgcccgcctcgcctccgaacggccg

SEQ ID NO: 386393 - DNA, 511 bp, Homo sapiens
  misc_feature: GZ8MTXP01D3N1K.22.86.H09.1.454.CMB.2.raw
  modified_base (310)..(310): a, c, t, g, unknown or other
  modified_base (417)..(417): a, c, t, g, unknown or other
  modified_base (473)..(473): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggaggtccctgagactctcctgtgcagcgtctggatcacttcagtggctatggcatgcactggcctccgcaggctccggggnaagggggctgggagtggggtggcaattatatgggtatagatgggaaataataaagctatgtggactcgtgaagggcgatcacatctcagagacactacaagacactntgtttctacaaatgaacagcctgagaggcgaaggacacggcttagtagtattacgnggttaggcgagaagactcggactaagttaagtaaccgg

SEQ ID NO: 386394 - DNA, 598 bp, Homo sapiens
  misc_feature: GZ8MTXP01CHOQ3.22.86.H09.1.454.CMB.2.raw
  modified_base (561)..(561): a, c, t, g, unknown or other
  modified_base (574)..(574): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtggggacggtccctgacgctctcctgtgcaggcgtctggtatcaccttcagtggctatggcatgcactggcctccgccgaggccgtccggggcgaagggggctgggaggtgggtgacctaagttagtagtggtaatgaatgggaaagtaaataaaggtctagtggtcgactccggtagaacgggccgtattaccacctatacctaccaagaacgaaccaaactaccaaacgtaaaccgtacctttaccgtttcgtttacctaacctaaaatcgaaacacgtacctagggaacggacggcggaacggaaccgacgggcttaggtagttattacgngttgaacgagaanacgtcgactaagttcggtaaacgg

SEQ ID NO: 386395 - DNA, 663 bp, Homo sapiens
  misc_feature: GZ8MTXP01BLV2N.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaaggggctgggagtgggtggctaattatatggtatgataggaaagtaataaagactatggtggactccgtgaaggcgattcaccatctcagagacaactccaaagaacactctcgttctacaaatcgaacaagcctgagagggcgaggacacgggcagtgtattacgtgtgcgaagagactacgacagtagaacgttaaacggggaaacgttcgttttagacgttcgtacggtacggggacccgtaaaggggacctaacggttcggtcccaacccggttcttccgtttaaccgaaccgttccccgttaaccccgaacccggaaaccgggggtcccccttaaacggtttccccggggttacccccttttcccccccgggtcggggtccccgttcccccgttcgggttccccgttaacccggaacgggtaaccccgg

SEQ ID NO: 386396 - DNA, 617 bp, Homo sapiens
  misc_feature: GZ8MTXP01A3I9T.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaaataaagactatgtggactccgtgaagggccgattcaccatctccagacgacaactccaaagaacactctcgtttcacaaatcaacaagcctgagaggcgaggacacggcagtgtatacgtgtgcgagagatacgacagtagaacgtaacgggaaagtcgttttagacgttcgtacggtcggggacccgaaagggaccacggttcggtacccgtaccgttccgttccttccgacgttccccgtacccaacccgaaaccggggtccccttacgttccccgggttccccttccccccggtcgggtccccgccccgttcggccccgttcccgaacgggtaaccccg

SEQ ID NO: 386397 - DNA, 634 bp, Homo sapiens
  misc_feature: GZ8MTXP01A0GCO.22.86.H09.1.454.CMB.2.raw
  modified_base (228)..(228): a, c, t, g, unknown or other
  modified_base (256)..(256): a, c, t, g, unknown or other
  modified_base (322)..(322): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgcaggctccgggngaaggggctgggagtgggtgacaattanatggtatgataggaaagtaataaagactagtgtggactccggtagaaggccatcacatctacaganacaactccaaagaactctcttcgtttaccacaaatacgaaacaacgaccgtggaaggacgggacgacgggaccgacgggactaaggtagttaattacgtggtcgagaaggagtatacgactagtacggaaacttaaacggggaaagttcggtttaggaacttccgtacgggtacggggaccgtaaacggggactacggtcggtacctaacccgttctccgttaacgaacgcccctaaccgaacccgtaaccgggccccttacggttcccgttccccttcccgcggccctccgtcgccctccgcgggtaaccc

SEQ ID NO: 386398 - DNA, 751 bp, Homo sapiens
  misc_feature: GZ8MTXP01BK3VQ.22.86.H09.1.454.CMB.2.raw
  modified_base (446)..(446): a, c, t, g, unknown or other
tcagacatacgcgtcacgaccggtgctcgatttagtgctatagacttgggtttgggctgagctgggttttcctcgttgctttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggcctccggggcaaggggctgggaggtgggtagcaattatagtggtatgataggaaagtaaataaagactagtgtaggactccggtaggaagggccgattccaccgatcctaccaaggacgaaccaactccgaaaagaacctacttcttcgtttacccctaccaaaatcgaaacagaccctaggaaggagggacgaagggaccacgggactaggtagttatttaacgnggtaggacgtaaggaagtagtaccgaatacgtaggaacgtaacggggtaaagttccgtttttaggggaactttcggttaccggtacgggggtaacccgtaaacggggaccgtacggttaccgggtaccgtaaccccgggtttcttccgtttacccgaaacccggtccccttaaaccccggaaccccggttaaacccgggtccccgtaacccgtttccccgggggttcccccctttccccccggtcgggggtaccccctcccccgtttccggcccgttacccgggaacggaacccgtaacccccgg

SEQ ID NO: 386399 - DNA, 556 bp, Homo sapiens
  misc_feature: GZ8MTXP01CBGAN.22.86.H09.1.454.CMB.2.raw
  modified_base (219)..(219): a, c, t, g, unknown or other
  modified_base (258)..(258): a, c, t, g, unknown or other
  modified_base (304)..(304): a, c, t, g, unknown or other
  modified_base (375)..(375): a, c, t, g, unknown or other
  modified_base (428)..(428): a, c, t, g, unknown or other
  modified_base (438)..(438): a, c, t, g, unknown or other
  modified_base (468)..(468): a, c, t, g, unknown or other
  modified_base (516)..(516): a, c, t, g, unknown or other
tcagacatacgcgtcacgaccggtgctcgatttagtgctatagacttgggtttggggggggtctcaggaggcagcactctcgggacgtctccaccatggcctgggctctgctcctcctcagccctcctcactcagggcacaggatcctgggctcagtctgccctgactcagcctcgctcagtgtccgggtctcctggacagtcagtcaccatctcctanactggaaccagcagtgatgttggtgtatactatgtctcnggtaccagcaccaccaggccaaacgcccccaaatcttaattttggngtacaactaacccgcccctagacggggtccctgactcgtcttcgtccccggctccaagtcctggaccaacnccggccctccctgacccatctctcggactcccgaggctgacgatcggagggtntactttacgngctgcctgattagtgcagcaactataaatntggtcttcgggcggaagggaaccaaaggtcgaccgttccgaggttccncgacccaagggcctcgccccctggcctcgttccgttcccg

SEQ ID NO: 386400 - DNA, 664 bp, Homo sapiens
  misc_feature: GZ8MTXP01AVPV9.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcgtccgggcgaaggggctgggaggtggggtggactaagttatagtggtatgagtaggaaagtaataaagactatggtaggactccgtaggaaagggccgtattccacctatctaccagaacgaacaaactaccaaagaacctacttcttaccgtttacctactaaagtacgaacaacgacctggaacggagggaccgaacgggacgacgggacgtagttacgtagttacgtggtgaacgagaagatacgaatagtacgaacgtaacgggtaaacgttcggttttacgagttccgttacggtacggggaccgtaagggaactacgtacggtaccgtaccgttccttaccttaacgaccgccctacccgaaccgaacgggtccccttacggttcccggttccccttccccggtcggccccgtcctcgccctaaccgcggtaacccg

SEQ ID NO: 386401 - DNA, 528 bp, Homo sapiens
  misc_feature: GZ8MTXP01BJN47.22.86.H09.1.454.CMB.2.raw
  modified_base (469)..(469): a, c, t, g, unknown or other
  modified_base (473)..(473): a, c, t, g, unknown or other
  modified_base (518)..(518): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattccaccttcagtggctatggcatgcactggctccgccaggctccgggcaaggggctgggagtgggtggcaattatatggtatgatggaaagtaataaagactatgtggactccgtgaaagggccgattcaccatctccagagacaactaccaagaacactctcgtttcctacaaatgaaacagcctgagcgcgagacacgcagtgtatatgtgcgagagatcgaatagtagacgtaacgggaaagtcgttttgagtctcgtggggaccaagggcacgtgtcacgtctntccncgcctaccacgaacggtcccacgttccgttctccccgtgcctccngcctcgaagc

SEQ ID NO: 386402 - DNA, 542 bp, Homo sapiens
  misc_feature: GZ8MTXP01EQV35.22.86.H09.1.454.CMB.2.raw
  modified_base (314)..(314): a, c, t, g, unknown or other
  modified_base (342)..(342): a, c, t, g, unknown or other
  modified_base (376)..(376): a, c, t, g, unknown or other
  modified_base (518)..(518): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtggggacgtccctgacgactctcctgtgcagcgtctggatcacttcagtggctatggcatgcactggcctccgcaggctccgggnaagggggctggagtggggtgacaattanagtggtatgaatggaaataaataaagctaatggnggtactcgtagaggcgatcacagtctacagacacaactacaaagaactacttctagtttaccaacctaaatacgaacacgcctaggacgaggccggaaggacgacgggcttaggtgttaattacgttggttgaagagtaagntaccggataagttaacgtaacggg

SEQ ID NO: 386403 - DNA, 684 bp, Homo sapiens
  misc_feature: GZ8MTXP01CFL9R.22.86.H09.1.454.CMB.2.raw
tcagacatacgcgtcacgaccggtgctcgatttagtgctatagacttgggtttgggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctgaccaacaacacccagaccaaaccccccatcatcatttatgtgtcactcgtcggccctcgaggactctactcatccgcttctcagcctaacccaagttctcgggacctaaacaccggccctaccccaactactccttcgtcgggcctcccgtagtttggaacggaccgtagttctactttatacctgtaccttaggtttaccctttaaaagtcggccgtcctaccgttcgttcggtttcgggtttccggacgggtacgggtacctaccgggtaaacggttcgttaaccccgggttcccgttccggggttacccaacgggttacccccgttaaagggggttccccttaacccgggtccccccccgttcggggtttccccaacccgtttcccgttaaccccggttttcccccccgtaaccccccg

SEQ ID NO: 386404 - DNA, 526 bp, Homo sapiens
  misc_feature: GZ8MTXP01CXX5L.22.86.H09.1.454.CMB.2.raw
  modified_base (261)..(261): a, c, t, g, unknown or other
  modified_base (315)..(315): a, c, t, g, unknown or other
  modified_base (367)..(367): a, c, t, g, unknown or other
  modified_base (372)..(372): a, c, t, g, unknown or other
  modified_base (375)..(375): a, c, t, g, unknown or other
  modified_base (377)..(377): a, c, t, g, unknown or other
  modified_base (379)..(379): a, c, t, g, unknown or other
  modified_base (381)..(381): a, c, t, g, unknown or other
  modified_base (383)..(383): a, c, t, g, unknown or other
  modified_base (390)..(393): a, c, t, g, unknown or other
  modified_base (395)..(395): a, c, t, g, unknown or other
  modified_base (399)..(399): a, c, t, g, unknown or other
  modified_base (402)..(402): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcaccatctcctacactggaaccagcagtgatgtgtgttataacatgtctcctggtaccaacagcacccaggcaaagccccagacncatcattaatgctgtcaataaagcggccctcagggggtcccctgatcgctttcnctggctccaaagtctggcaaacacggtcctccctgaccaatctctggggccncagcnganangngntnatatatnnnntntatncgngcgctacacgtggtggtcggacggacggacgaacgcgtcgtaaccgtccgttacggtcgacgaccgaacgaccgttccgccccgtcccgtccgtaacctctcgttccctccccgttcccgtccg

SEQ ID NO: 386405 - DNA, 561 bp, Homo sapiens
  misc_feature: GZ8MTXP01CKMSC.22.86.H09.1.454.CMB.2.raw
  modified_base (334)..(334): a, c, t, g, unknown or other
  modified_base (351)..(351): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaggccgattcaccatctccagagacaactccaagaacnctctcgtttcacaaatnaacagcctgagagggcgaggacacggcagtgtattactgtgcgagagatcgacatgaacgtacgggaaagtcgtttgagttcgtcgtcggggaccgaagggacacgtcggtccaaccgttcgtcttcgacgcctacccacccgaacgggccccacgttcccggttccccttcccccgtcggtcccgcccgtcgcctccgaacggaacccg

SEQ ID NO: 386406 - DNA, 601 bp, Homo sapiens
  misc_feature: GZ8MTXP01CJAEW.22.86.H09.1.454.CMB.2.raw
  modified_base (577)..(577): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtggggacggtccctggagacctctcctggtgcagcgtctggatcaccttcagtggctatggcagtgcacgtggctcccgcgaggcgtcccggggagaagggggctgggacggtggggtagcctaattagtagtggtataggaattgggaaataaactaaagtctaagtgggtacgacgtccggtaggaacgggcctaattaccacctaattcctaccgaagaacgaaccaaactaccgaaagaaacctcttactttgttacctaaccaaaagtcggaaacacgccgtaggaacgacgggacgaaggaccgacggggacaggttacgttagttaccgttggcgaagagngactcgactaagaagtaaaccggg

SEQ ID NO: 386407 - DNA, 656 bp, Homo sapiens
  misc_feature: GZ8MTXP01DG1L1.22.86.H09.1.454.CMB.2.raw
  modified_base (267)..(267): a, c, t, g, unknown or other
  modified_base (280)..(280): a, c, t, g, unknown or other
  modified_base (541)..(541): a, c, t, g, unknown or other
  modified_base (616)..(616): a, c, t, g, unknown or other
tcagacatacgcgtcacgaccggtgctcgatttagtgctatagacttggggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtgggtggaggtcgtgggggagcgtggtccagccgtgggacgtcctgagctctccgtgtgcagcgtntggcttccacttnagtggctagtggcatcgctacgtcggcctcccggacgacgggccgtccgggggacggaaagggggtcgtaggggagggtcggggtaggactaaagtttgtagtggtatggaagttaggaaaaaacgttaaataaggtacttagtgggtacgggtaccgtacgggtaggaaaccggggtcctagttaccaacctactacctacccgaaagaacgaaccaaacctaccaaacgtaactaccttacttacgtttaaccctaaanaaactacgaactaacgtccgaggaacggaggacggaggacgacggaataagttgttaaattcgtggcgacgaagngtaataccgaatagagttaaccggtaagggttaagtttcg

SEQ ID NO: 386408 - DNA, 614 bp, Homo sapiens
  misc_feature: GZ8MTXP01CJ12H.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggnaaggggctgggagtgggtgctaattatatggtatgataggaaagtaaataaagactaatggtggacgtccgtaggaaacgggccgattccaccatctcagacgaacaactacaaagaaccactctcgtttacacaaatcaacaagcctggagaagggcgaggacacggctagtagtattacgtgtgcgaagagatacgacatacgtaacgtaacggggtaaagttcgttttagactttcgtacggtacgggggaccgaaacgggactaacgttcggtacctaccggttcttccgttaaccgacgttccctacccgaaccgtaaacgggccccttacgttcccggttcccgttccccgtcggccctcccgtcgcctccgcggaacccg

SEQ ID NO: 386409 - DNA, 700 bp, Homo sapiens
  misc_feature: GZ8MTXP01ETJCO.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtggggagtccctgagactctcctgtgcagcgtctggatcacttcagtggctatggcatgcacgtggcctccgccgaggccgtcccgggagaagggggctgggaggtggggtgacctaatttagtagtggtataggaagttaagggaaaagttaaactaaaagacgttaagttgggtacgggtaaccgttacccggtagggaaacggggtcccgtaactttcccgaaccctaacttcccgttaccgaaggaacgaaacccaaaccttaacccgaaacgtaaacccgtactttaccgtttacgtttaccctaaaccctaaaagttacgaaaccgacgtcccgttaggaaacgggacggggaccggaaacggggaaccgaccggggaccgttaagggtttacgttaagtttaaccgttgggttacggaacggaaggaagtacgttaccggaacgtaagttaacggtaaaaccggg

SEQ ID NO: 386410 - DNA, 618 bp, Homo sapiens
  misc_feature: GZ8MTXP01AF6Q6.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccgaggccgtccgggcgaagggggctgggagtggggtggactaattatagtggtatgataggaaagtaaataaagactagtggtggactccgtaggaagggccgattcacatctaccagagaacaactaccaaagaacactctcgtttacacaaatacgaacaagcctaagagacgggacgacggacgacggcagtcgtaattcgtggtgacgagagactcgacagtagaacgtacgggtaatcgttttgatcgtacggtaggggaccaagggactacgtcggtaccctaccgttcctcgttcgaaccgttcccgtacccgaacccggtaaacgggtccccttacggttcccgttaccccttcccccggtcggcccgtccccgtgcccgtccgaacggtcccg

SEQ ID NO: 386411 - DNA, 631 bp, Homo sapiens
  misc_feature: GZ8MTXP01AJUAP.22.86.H09.1.454.CMB.2.raw
  modified_base (226)..(226): a, c, t, g, unknown or other
  modified_base (333)..(333): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctgggagtggggtggcaattatatggtatgatggaaagtaaataaagactatgtggactccgtgaaagggccgattcaccatctccagagacaactccaanaacactctgtttcctacaaatcgaacaagcctgagagggcgagacacgcagtgtatactgtgcgagagatcgacagttacgacgtaacgggtaaagtcgttttgaattccgtacgtgggggacccaaaggggacctaacgtcgggtactacccggttcctcgtttccacgttaccctaccccgaaccgtaaacccgggggtccccttaacggtttccccggggttcccctttccccccccggtggggtcccccgcccccgttccggttaacccgttccccggaacgggggtaaccccg

SEQ ID NO: 386412 - DNA, 586 bp, Homo sapiens
  misc_feature: GZ8MTXP01BRM5G.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggcaattatatggtatgataggaaagtaataaagactatgtggactccgtgaagggccgattcaccatctccagacgacaactccaaagaacactctcgtttcacaaatgaacagcctgagaggcgaggacacggcagtgtattacgtgtgcgagagatcgacagtagaacgtaacggggtaaatcgttttagattcgtacgtcggggacccgaagggtacacgttggtacctaccggttcctcgttcacgttccctacccgaaccgaaaccgggccccttacgttcccggttcccttcccccgtcggcccgtcccgtcgccctccgaacggtaacccg

SEQ ID NO: 386413 - DNA, 583 bp, Homo sapiens
  misc_feature: GZ8MTXP01ALH42.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggaggtggggtggcaattatatggtatgatggaaagtaaataaagactatggtggactccggtgaagggccgattcaccatctccagagacaactccaaagaacactctcgtttacacaaatgaacaagcctgagaggcgaggacacggcagtgtatacgtgtgacgagagatcgacagtagaacgtaacggggtaaatcgttttagagttcgtacgtcgggggaccaaggggactacgtggtccaccgtctcttcgacgcctacccaccgtaaacgggccccttacgttcccgggttcccttcccccgtggcccgtccccgtgttacccgtcccgaacgggcccg

SEQ ID NO: 386414 - DNA, 783 bp, Homo sapiens
  misc_feature: GZ8MTXP01CF6YK.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccgaggccgtccgggcgaagggggctgggagtggggtggactaaagttatagtggtatgaagtagggaaagtaaataaagactaagtggtacggacgtccggtaggaaacggggcccgtaatttccgaaccctattacccgtacccgaaaggtaacgaaaccctaaacctacccaaaacgtaaaccacctttccttacgttttaccacctaaaagtacgaaaccaacgtaccctggaaacggacggggacggaacgggaaccgaccggggtataaggttagttagtttaaccgtggtgacgaagagaagtaccgacagtagaacgtaagggtaaacgttcgtttttcggaagttccgtaccgggtacggggtaacccgaaaacggggtacctaaccggttcggtacccgtaccccggtttccttaccgtttaacccgaaccggacccccttacccgaaaccccggaaaccggggtccccttaacggtttccccggggttacccccttccccccgggtcgggtcccccgtcccgttaccggccccgttcccggaacggggtaaccccg

SEQ ID NO: 386415 - DNA, 635 bp, Homo sapiens
  misc_feature: GZ8MTXP01DC8EA.22.86.H09.1.454.CMB.2.raw
  modified_base (349)..(349): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgcgacggcgtccgggcgaaggggctgggaggtgggtggactaattatagtggtatgaataggaaagtaaataaagactagtgtggactccgtagaaggccgattcacatctccagacgacaactcaaagaacnctcttcgttactacaatacgaacaacgcctgagaggacgagacacggcagtgtatacgtgtgacgagagtatcgacagtagaacgtaacgggtaaagtcggttttagacgttcgtacggtacggggaccgaagggtaccgaacgttcggtccgaacccgttctccttaacgaccgccctaaccccgaccggtaaaccgggtccccttacggttccccggttccccgtttccccccggtcgggtccccgtccccgtcggttaccccgttccggaaccggtaacccgg

SEQ ID NO: 386416 - DNA, 601 bp, Homo sapiens
  misc_feature: GZ8MTXP01AXE9B.22.86.H09.1.454.CMB.2.raw
  modified_base (564)..(564): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggagtgggtggcaattatagtggtatgataggaaagtaaataaagactatgtggactccgtagaagggccgattcaccatctccagacgacaactccaaagaacactctcgtttacacaaatcgaacaagcctgagaggacgaggacacgggctagtgtattacgtgtgcgagagatacgacagtagaacgtaacgggaaagtcgttttagacgttcgacggtcggggaccgaaggggactacgttcggtccctaccggttcttcgttaacaaccgttccctacccgaccgaaacgggtccccttacgttcccggttcccttcccccgnggccccgtcccgtcgttcccgtccgaacgggaacccg

SEQ ID NO: 386417 - DNA, 607 bp, Homo sapiens
  misc_feature: GZ8MTXP01ALTMG.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgccaggctccgggcaaggggctgggagtggggtggcaattatatggtatgatggaaagtaataaagactatgtggactccgtgaaggccgattcacatctccagacgacaactaccaagaacactctcgttactacaaatcgaacaagcctgagaggcgaggacacggcagtgtatactgtgcgagagatcgacagtagaacgtaacgggtaaagtcgtttagacttcgtacggtcggggaccgaaggggacctaacggtcggtaccctacccggttctctttcccgaacgttccctacccgaacccgtaaaccgggccccttaacggttcccgttccccgttccccccgtcgggtccccgtccccgtcggcccttcccgaacgggaacccg

SEQ ID NO: 386418 - DNA, 591 bp, Homo sapiens
  misc_feature: GZ8MTXP01CB8W9.22.86.H09.1.454.CMB.2.raw
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggacaattatatggtatgataggaagtaaataaagactatgtggactccgtgaagggccgattcaccatctccagagacaactccaaagaactactctcgtttcacaaatgaaacaagcctgagaggacgaggacacggcagtgtatntagtgcgagagatcgacatgaacgtacgggaaagtcgttttaggattcgtacgtagggggacccaaaggggactaacgtggtccacccggtctccttcaacgccctacccgaaccgaaacggggtcccttacgttcccgggttccctttccccccgcggtcccggtccccttcggcccttccgaacgggtaacccg

SEQ ID NO: 386419 - DNA, 616 bp, Homo sapiens
  misc_feature: GZ8MTXP01DHOXK.22.86.H09.1.454.CMB.2.raw
  modified_base (310)..(310): a, c, t, g, unknown or other
  modified_base (330)..(330): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgcaggcctccgggcaaggggctgggagtgggtgactaattatatggtatgataggaaataataaagactatgtgactcgtgaaggcatcacatcncagagaacaactacaagacnctcttcgttcacaaatacgaacacgctgagagggacgaaggacacggcagtgtatactgtgacgagagatcgacagtacgaacgtaacggaaacgttcgttttagattaccgtacggtacggggaaccgaagggtacaacgttcggtacctaaccgttcttcccttaacaccggttccctacccgaaccggtaaaccgggccccttaacggttcccggttcccccgtttccccgggccggtcccggtccccgtcgttaccccgtaacccggaacgggtaaccccgg

SEQ ID NO: 386420 - DNA, 602 bp, Homo sapiens
  misc_feature: GZ8MTXP01BHVD0.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtgctaattatatggtatgataggaaagtaataaagactatgtggactcgtgaaggcgatcacatctcagacgacaactaccaagaacactcttacgttactacaaatgaacaacgacctgagacgggacgaggacgacggctagtcgtaattacgtgtgacgagagactacgaactagtagaacctaaggggaaatcgttttaggacttacgtcgtagggggacccaaaggggacctaacgtcggtaccgtacccggttcttccttaacgacgccccttacccgaaccgtaacggggccccttacgttcccggttccctcccccgtgggcccctccctcggcctcccgaaggaacccg

SEQ ID NO: 386421 - DNA, 567 bp, Homo sapiens
  misc_feature: GZ8MTXP01CZ7BN.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcacctttcagtggctatggcatgcactggctccgccaggctccgggcaaggggctgggagtgggtggcaattatatggtatgataggaaagtaataaagactatgtgactcgtgaaaggccgatcacatctaccagagacaactccaaagacatctcgtttcacaatgaacaagcctgagagcgaggacacggcagtgtatactgtgacgagagatacgacagtagaacgtaacgggaaattcgtttagattccgtcggtacggggaccaaggggactaacgtcggtaccaccgtcttccttcacggcctacccgacgtaacgggcccttacgttcccggttcccttcccccgtggccccgtccctgcccttccgaagggaaccc

SEQ ID NO: 386422 - DNA, 620 bp, Homo sapiens
  misc_feature: GZ8MTXP01BU8UL.22.86.H09.1.454.CMB.2.raw
  modified_base (240)..(240): a, c, t, g, unknown or other
  modified_base (370)..(370): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgatgttggtgttataactatgtctctgtaccaangccacccaggcaaacgccccagactcatctatttatgctgtacaataagccggccctcgacggggtcccctgactcgctttctcgtggctcaagtcgtcggacaacgaccggtccctccctacgaccctntctcgtcgggcctccgaggctagaagagtggaggctagtattattactgtctgctactagtttcgacgacggtccgtcctaacgtcggttggggtcgttaccggggaccgggtaagggaaccctaaggtccgtcggaaccccgttcgttaacggtccgaccggacccgtaacgggcccgttcccggccccccgttaacgggtccctaacccgttcccgtacccgttccccctaacccgttcccgtaaccg

SEQ ID NO: 386423 - DNA, 602 bp, Homo sapiens
  misc_feature: GZ8MTXP01C87OC.22.86.H09.1.454.CMB.2.raw
  modified_base (254)..(254): a, c, t, g, unknown or other
  modified_base (283)..(283): a, c, t, g, unknown or other
  modified_base (560)..(560): a, c, t, g, unknown or other
  modified_base (567)..(567): a, c, t, g, unknown or other
  modified_base (573)..(573): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcgtggttttcctcgttgctcttttaagaggtgtccagtgtcaggtgcagcgtggtggagtcgtgggggagcgtggtccagccgtgggagtccctgagtctctccgtgngcagcgtctgattcaccttgagtgctagnggcagtgcacgtcggcctcccgcgacggccgtccggggacgaagggggtccttggggaggttgggggacggtataaatttagttaggtaggttataggaagtaggtaaaaaacgttaaataaggtattaagtggtacggacctttacgggaggaacgggcctaacttcaacctattccaccaagacaactaacaccaaagaactacttccttagtttacctacaaaattcgaaacgcgcgagaacggagcgaagcgtacggaatgttagtacttagngacgagngagaanagaacagtagttacgtaacggttaagttg

SEQ ID NO: 386424 - DNA, 536 bp, Homo sapiens
  misc_feature: GZ8MTXP01AGUI2.22.86.H09.1.454.CMB.2.raw
  modified_base (349)..(349): a, c, t, g, unknown or other
  modified_base (415)..(415): a, c, t, g, unknown or other
  modified_base (528)..(528): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctggagtgggtggcaattatatggtatgatggaaagtaataaagactatgtggactccgtgaaggccgattcacatctccagagacaactcaaagaacactctcgttcacaaatnaacagcctgagagcgagacacggcagtgtattactgtgcgagagatcgacatgacgtacgggaaancgtttgatctcgtggggcctaagggacacgtcggtccaccgtctcttcacgcctccaccgaacgggccccagttcccggttccttcccccgtggcccgccccgttgcctccgnggaacccg

SEQ ID NO: 386425 - DNA, 722 bp, Homo sapiens
  misc_feature: GZ8MTXP01DYXAV.22.86.H09.1.454.CMB.2.raw
  modified_base (318)..(318): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcgtctggatcacttcagtggctagtggcatgctacgtggccctccgcgaggccgtcccggggnaaggggggctaggggaggtggggtacggacctaaagtttagtagtgggttactaaggaaagttaagggaaaagtttaaaataaaacggtacgttaagttcgggttagggtaacccgttacccggtagggaaaacggggtccgtaactttccgaaacccgtaacttccgtaacccaaggaaaccgaaaccaaaccgttaaccgaaacgtaacctaaccgttctttacgttttacctaacctaaaagttcgaaacgaaacgtcccgtaaggaacgggaacgggccgggaaacggaacccgaacgggtaccgttaagggtttacgtttaaacgtttaacggttcggttaggaaccggtaaagaaggtaaacgttcggaaccgttaaggttaacggttaaaacccggg

SEQ ID NO: 386426 - DNA, 621 bp, Homo sapiens
  misc_feature: GZ8MTXP01AY3TJ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtgcaattatatggtatgatggaaagtaaataaagactatgtggactccgtgaagggccgattcaccatctaccagacgacaactaccaaagaacactctcgtttacctacaaatgaacaagcctgagagggcgaggactacggctagtgtattactgtgacgagagatacgacagtagaacgtaacggggtaaagtcgttttagaagttcgtcggtacgggggaccgaagggggacctaacgtcggtccgtaacccggttccttccttcaacgttcccctacccgaacccgaaaccggggtccccttacgttcccggttccccgtttcccccgcgggtccccgtccccgtcggttccctcccggaacggtaacccg

SEQ ID NO: 386427 - DNA, 560 bp, Homo sapiens
  misc_feature: GZ8MTXP01EAN9N.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaagggggctgggagtgggtggcaattatatggtatgatggaaagtaataaagactatgtggactccgtgaaagggccgattcaccatctccagagacaactccaaagaacactctcgttctacaaatgaaacaagcctgagaggcgaggacacgggcagtgtattaactgtgcgagagatcgacatgactaacgggaaatcgttttgattctcgtggggccaaagggacaacgtggtcaccgtctcttcacgcctccgaccgaaacgggccccaagttcccgggttccttcccccccgttggggccccgccctccgccgtccgaacggaacg

SEQ ID NO: 386428 - DNA, 537 bp, Homo sapiens
  misc_feature: GZ8MTXP01BGKZ0.22.86.H09.1.454.CMB.2.raw
  modified_base (473)..(473): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtgcaattatatggtatgatggaagtaaataaagactatgtggactccgtgaagggcgattcaccatctccagagacaactcaaagaacactctcgtttacacaaatgaacaagccctgagagggcgaggacacgggcagtgtattacgtgtgcgagagatcgacattagaacgtaacgggaaagtcgtttgatcgtacgtgggcaaggcacgtgtccacgtctcttcancctccacgaacggcccacgttccggttccctccccgtcggccgccctgcctccgaacggaaccg

SEQ ID NO: 386429 - DNA, 630 bp, Homo sapiens
  misc_feature: GZ8MTXP01CBV6V.22.86.H09.1.454.CMB.2.raw
  modified_base (548)..(548): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggaggtcgtgggggagcgtggtccaggccgtggggacggtccctgacgactctccgtgtgcagcgtctggatcactcagtggctagtggctagtgctacgtggcctcccggccgacgggtccgtcccgggggacgaaggggggtcgtaggggtaggtgggggtaggacctaagttagtagtggtaatagaagtaagggaaagttaaagtaaagtactagtcgggtagtaaccgttccggtaggaacggggcctaattaccaccgtaatcctacgaagacgaaccaaactaccaaagaacctacttcgttacttacaaccaaatcgaaacgacgccgtaggaacggacggnggaacgacgacgggtacaggttagtacgttacgttggttcggaacgaggaagtataccggaataagttaacggtaaaccggg

SEQ ID NO: 386430 - DNA, 686 bp, Homo sapiens
  misc_feature: GZ8MTXP01ELT94.22.86.H09.1.454.CMB.2.raw
  modified_base (313)..(313): a, c, t, g, unknown or other
  modified_base (345)..(345): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggatcaccttcagtggctatggcatgcacgtggcctccgcagggcgtcccgggnaagggggctgggaggtggggtgactaatttanagtggtataggaattgggaaattaaataaacggacttaagttgggtacgggtaaccgttcccggtagggaaacggggtcccgtaatttaccaaccctaattcccgttaccgaaggaacgaaacccaaaccttaacccgaaaacggaaacctaaccctttacctttacgttttaccctaacccgtaaaattaccggtaaacaaccggtcccgttagggaacgggaacggggacggaaacgggtacccgaacggggtaccgttaacggttagggttaatttaaccggttggttaggaaccggtaggtaagacgttacgaacgttaagttaacggtaaaccggg

SEQ ID NO: 386431 - DNA, 659 bp, Homo sapiens
  misc_feature: GZ8MTXP01AS0TX.22.86.H09.1.454.CMB.2.raw
  modified_base (345)..(345): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggctccgggcaaggggctgggaggtgggtggactaattatagtggtatgataggaaagtaaataagactatgtggactcggtgaaagggccgattcaccatctccaagacgaacaactcaaagacnctcttcgttctacaaatcgaacagcctgagagggacgaggacacggctagtgtattacgtgtgcgagagagtcgaactagtacgaacggtaacggggtaaacgttcgttttaggacttcggtaccggtacgggggacccgtaaacggggacctaacgttcggggtaccctaaccgggttccttcccgttaaccaccgggttacccctacccgaaacccggaaacccggggtccccttacggtttcccgggttcccctttcccccggcgggtccccgtccccgtcggttccctaacccgggaacgggtaaccccg

SEQ ID NO: 386432 - DNA, 575 bp, Homo sapiens
  misc_feature: GZ8MTXP01C91JD.22.86.H09.1.454.CMB.2.raw
  modified_base (280)..(280): a, c, t, g, unknown or other
  modified_base (532)..(532): a, c, t, g, unknown or other
  modified_base (538)..(538): a, c, t, g, unknown or other
  modified_base (547)..(547): a, c, t, g, unknown or other
  modified_base (550)..(550): a, c, t, g, unknown or other
  modified_base (560)..(560): a, c, t, g, unknown or other
  modified_base (567)..(567): a, c, t, g, unknown or other
tcagacatacgcgtcacgaccggtgctcgatttagtgctatagacttgagctctgggagaggagcccagcactagaagtcggcggtgttccattcgctgatcagcactgaacacagaggactcaccatggagtttgggctgagcttgggttttcctcgttgctcttttaagaggtgtccagtgtcaggtgcagctgggtggagtcgtgggggagcgtggtccaggcctgggagtccctgagactctcctgtgcagcgtctggattcacttcagtgctagngcatgcacgtggctccgcgaggcctccggggcaagggggctgggaggtggggtcgactaaatttgtaagtgggtaaatgaagttagggaaaattaaactaaaaggctaagtgggtacggaacttccggtaggaaacggggctaacttccaacctatccgtaccgaagaacgaaccaaactacccaaaggtaacctacttctacgttactaaccaaatcgaaacacgccgtagacggaggcgaggacgacggngtagtnttagttcgnggngagaagaganacgtaanaacgtaag

SEQ ID NO: 386433 - DNA, 608 bp, Homo sapiens
  misc_feature: GZ8MTXP01CODGU.22.86.H09.1.454.CMB.2.raw
  modified_base (252)..(252): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattanatggtatgatggaagtaataaagactaatgtggactccgtgaagggccgattcaccatctccagacgaacaactaccaaagaacactctcgtttcacaaatcgaactaagcctgagaggcgaggacacggcagtgtatactgtgcgagagatcgaacatagaactaacgggaaagtcgttttaggaattcgtacgtacgggggacccaaaggggaccaacgtcggtccaacccggttctccttcgaacggcccttacccgaacccgtaaacggggcccccttaacggttcccgggttaccccttccccccgtgggccccgtccccttgggccccttaacccgaacgggtaacccgg

SEQ ID NO: 386434 - DNA, 584 bp, Homo sapiens
  misc_feature: GZ8MTXP01EV2MW.22.86.H09.1.454.CMB.2.raw
  modified_base (259)..(259): a, c, t, g, unknown or other
  modified_base (270)..(270): a, c, t, g, unknown or other
  modified_base (504)..(504): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcctgggagtccctgagtctctcctgtgcagcgtcnggatcaccttnagtgctagtggcatgcacgtggcctcccgcgagggccgtcccgggcgaagggggctgggaggtggggtgaccaagtttagagtggtatagaagtggtaaataaataaagactagtggtgactcggaggaacggtccgattccgactactctaccagaacacctaaactaccaaacgtaacctcttacttacgtttaccaacctaaagtccgaaacacggcctaggaggacgggnggaacggacgacgggacttaggttattaagttacgttggaggaacgagtaacgacgtcgataacgttaaggtaaaccggg

SEQ ID NO: 386435 - DNA, 632 bp, Homo sapiens
  misc_feature: GZ8MTXP01ALAR2.22.86.H09.1.454.CMB.2.raw
  modified_base (172)..(172): a, c, t, g, unknown or other
  modified_base (447)..(447): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggaggcgtggtccagccgtggggacggtccctgacgactctcctgtgcagcgtctggatccaccttcagtggctatggcatgcactggctccgcaggccgtcgggcaagggggctgggagtggggtgaccaattatagtggtatagaagtcgggaaataaagtaaagctaagtgggtagacgtccggtagaacgggtccgagttccaccatctaccaagacgaacaaactaccgaaanaccgtaaccttcgtttacgtttacctaacccaaagttacgaaacccgtacgtacccgtaaggaaacgggaaccggggacggtaaacgggaaccgttacgggggaccttaagggttacgttaagtttacccgttgggttacggaacggagtaacgtacgtaacggactaagttcgtaaaaccgggg

SEQ ID NO: 386436 - DNA, 694 bp, Homo sapiens
  misc_feature: GZ8MTXP01BZN7N.22.86.H09.1.454.CMB.2.raw
  modified_base (238)..(238): a, c, t, g, unknown or other
  modified_base (259)..(259): a, c, t, g, unknown or other
  modified_base (307)..(307): a, c, t, g, unknown or other
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagctgggttttcctcgttgctcttttaagaggtgtccagtgtcaggtgcagctggtggagtcgtgggggagcgtggtccaggcctggggagtcccngagctctcctgtgcagcgtcnggatcacttcagtgctatggcatgcactggctccgcaggcctccgggngaagggggctgggagtggggtagcctaagttatagtggtatgaatgggaaataaagaaagtactagtcggtagggacctaccggtaggaaacgggtccgtagttaccaaccctaacgttccgtaccgaaaggacgaaaccaaaaccgttaacccaaaacggtaaacctaaccgttaccgtttacgttttacccctaaccctaaaacgttcgaaaaccgtacggacccgttaggaaacgggaacggggaccggaaacggggaacccgttaaccgggggtaccgttaaggttacgggtttaaacgtttacccggttgggttaccggtaaccgggtaaacggaaggtaacggttaccgaaaccggtaagtttaaccgggtaaaaccgggg

SEQ ID NO: 386437 - DNA, 748 bp, Homo sapiens
  misc_feature: GZ8MTXP01E0V24.22.86.H09.1.454.CMB.2.raw
  modified_base (301)..(301): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagttttgggctgagcttgggttttcctcgttgcttcttttaagaggtgtccagtgtcaggtgcagctggtggagtcgtgggagaggcgtggtccagccgtggggacgtccctgagactctccgtgtcgcagcgtctggacttcaccttnagtggctagtcggcagtcgactacgtcggcccttcccggccgagggcccgtcccgggggacgtaagggggtcccgttagggggaggttgggggtacggacttaaaaaagtttagtaaggttaggggttaaatagggtaaagtaggggtaaaagttaaaagttaaaacgtacgttaagtcggtacgggtaaccgttaccgggtaagggtaaacggggtcccgttaattacccgaacctacgtaccctaaccgaacggaaccgggtaaacctaaaaccgttaacccgaaacggtaaaccctaaccgttcctttaacgtttaccctaaacctaaaagttaccgaaaacgtacggaaccgttaggaaacgggaacgggaccgggaaacgggaaccgacgggcgttaggttaaggttaacttaacgtggtacggacggtaaagaacgtaacg

SEQ ID NO: 386438 - DNA, 626 bp, Homo sapiens
  misc_feature: GZ8MTXP01BOJNF.22.86.H09.1.454.CMB.2.raw
  modified_base (193)..(193): a, c, t, g, unknown or other
  modified_base (274)..(274): a, c, t, g, unknown or other
  modified_base (319)..(319): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtncagctggtggagtcgtgggggagcgtggtccagccgtgggacgtccctgacgtctctcctgtgcagcgtctggatcacttnagtgctagtggcatgcacgtggcctccgcgaggccgtcccggggngaagggggtctgggaggttggggtacgacctaaagtttagtagtggtataaggaagtaagggaaataaacgtaaagctagtggtagtaccgtcggtaggaacgggtccgattccaacctatacctacgaaggacaacctaactaccgaaagtacctacttactttacgtttaacctaaccgaaagttaccggaaactacggtccgtaggaacgacgggacggaaaggaccgacgggtacttaggttagttaacgtttacgttggttaccgaagaagaagtacgtacgactaaggttcgtaaaccggg

SEQ ID NO: 386439 - DNA, 640 bp, Homo sapiens
  misc_feature: GZ8MTXP01EGASW.22.86.H09.1.454.CMB.2.raw
  modified_base (226)..(226): a, c, t, g, unknown or other
  modified_base (442)..(442): a, c, t, g, unknown or other
tcagacatacgcgtcacgaccggtgctcgatttagtgctatagacttgggtttgggctgagctgggttttcctcgttgctcttttaagaggtgtccagtgtcaggcgcagctggtggagtctgggggaggcgtggtccagcctgggaggtccctgagactctcctgtgcagcgtctggattcaccttcagtggctatggcatgcactggctccgcaggctccgggnaaggggctggagtgggtgactaattatatggtatgaataggaaagtaaataaagactatggtgactccggtaggaagggccgtattccaacctatactaccaagacgaacaactaccaaagaactactcttcgtttacctacaaatacgaaacaacgcctggagacggacgaggaacgacggacagttgtattacgtgtcgagagacgataccganagtagaacgtaaacgggtaattcggtttagacttcgtcggacggggtaccgaaacggggactaacggtcgtacctaaccggttctccgttaacctaacgcccttacccgaaacccgtaaacggtccccttaaccggttcccggttaccccttcccccgtcgggcccctcccgtcgttacccgtccggaacgtaacccg

SEQ ID NO: 386440 - DNA, 540 bp, Homo sapiens
  misc_feature: GZ8MTXP01CPUKA.22.86.H09.1.454.CMB.2.raw
  modified_base (237)..(237): a, c, t, g, unknown or other
  modified_base (261)..(261): a, c, t, g, unknown or other
  modified_base (271)..(271): a, c, t, g, unknown or other
  modified_base (335)..(335): a, c, t, g, unknown or other
  modified_base (351)..(351): a, c, t, g, unknown or other
  modified_base (380)..(380): a, c, t, g, unknown or other
  modified_base (493)..(493): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcaccatctcctacactggaaccagcagtgatgttgtgttataactatgtctctgtaccaanagcaccaggcaaacgccccagacncatcatttangctgtacaataagccggccctcgacggggtccctgatcgcttctctgcctcagtctcggcaacnccgcctccctgacctntctcgtcgggcctaccgagggctagaagngtggaggtctgtaatttattactgcttgctacgtatttcgacgaacggccgtacctacgtacgtttggggtgttcgggacggacggacccaggtcctgaacccgtcgaggtcncgaccgagccgttcgcccctgctctctacgttccctaacttccgtcg

SEQ ID NO: 386441 - DNA, 506 bp, Homo sapiens
  misc_feature: GZ8MTXP01E3FSD.22.86.H09.1.454.CMB.2.raw
  modified_base (338)..(338): a, c, t, g, unknown or other
  modified_base (467)..(467): a, c, t, g, unknown or other
  modified_base (489)..(489): a, c, t, g, unknown or other
  modified_base (500)..(500): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagtcgtctggatcaccttcagtggctatggcatgcactggctccgcaggctccgggcaagggggctggagtggggtgccaattanatggtatgatggaaagtaaataaagactagtgtggactcgtgaagggccgatcaccatctacagagacaactaccaaagaacactctgtttacacaaatgaaacagcctgagaggcgaaggacacgggnagtgtaattacttgttgcgagngatcgacaagngtaacg

SEQ ID NO: 386442 - DNA, 632 bp, Homo sapiens
  misc_feature: GZ8MTXP01C2OOM.22.86.H09.1.454.CMB.2.raw
  modified_base (191)..(191): a, c, t, g, unknown or other
  modified_base (260)..(260): a, c, t, g, unknown or other
  modified_base (272)..(272): a, c, t, g, unknown or other
  modified_base (610)..(610): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtncagcgtggtggagtcgtgggggagcgtggtccagccgtgggacgtccctgagctctcctgtgcagcgtntggatcaccttnagtggctatggcatgctacgtggcctccgccgacgggcgtcccggggcgaagggggtctagggaggtggggtcgacctaattagtagtggtataggaagtaaggaaagtaaataaagtactagtaggtacggacgtcccgtaggaacgggtccgtattccgaacctatccgtaccaaagaacgaactaaacctaaccgaaaccgtaactaaccttaccgtttacgtttaccctaaaccgtaaacgtacgaaaccgtacgaccgtagggaaacggacgggacggaacggaaccgacggtcgttaagtacgttattacgttgttagaagtagaacggtancggactaagttaacgtaaacgg

SEQ ID NO: 386443 - DNA, 599 bp, Homo sapiens
  misc_feature: GZ8MTXP01AHR7L.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtggctaattatatggtatgataggaaataaataaagactatggtggactccgtggaaggccgattcacatctccagagacaactcaaacgaacactctcgttacacaaatcgaacaagcctgagacgggacgaggacacggcagtcgtattacgtgtgacggagagatcgaacagtgaacgtaacgggtaaatcgttttagagttccgtcggtacggggaccaaaggggtacctacgtgggtccctaaccggttccttccgttaacaccgttccctacccgaaccgaaaccggggccccttacgttcccggttcccctttccccggcggccgccccttggaccctccgcgggaaccc

SEQ ID NO: 386444 - DNA, 504 bp, Homo sapiens
  misc_feature: GZ8MTXP01EUHHW.22.86.H09.1.454.CMB.2.raw
  modified_base (272)..(272): a, c, t, g, unknown or other
  modified_base (343)..(343): a, c, t, g, unknown or other
  modified_base (360)..(360): a, c, t, g, unknown or other
  modified_base (363)..(363): a, c, t, g, unknown or other
  modified_base (450)..(450): a, c, t, g, unknown or other
  modified_base (454)..(454): a, c, t, g, unknown or other
  modified_base (468)..(468): a, c, t, g, unknown or other
  modified_base (474)..(474): a, c, t, g, unknown or other
  modified_base (477)..(477): a, c, t, g, unknown or other
  modified_base (484)..(484): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttnagtggctatggcatgcactggctccgcaggctccgggcaaggggctgggagtggtgcaaattatatggtangatggaaaataataagntangtgactcgtgaagggcatcacatctacagagacaactcaacgaacacttctaggtttcacaaaatgaacacgctgagaggcgagacncggnaagttgtattacgngtgcgngangtcgaanatagacgtaacggttaagtg

SEQ ID NO: 386445 - DNA, 602 bp, Homo sapiens
  misc_feature: GZ8MTXP01B3AMN.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaagggggctgggagtgggtggcaattatatggtatgatggaagtaataaagactatgtggactccgtgaaagggccgattcaccatctccagagacaactccaaagaacactctgtttctccaaatgaacaagccctgagaggcgaggacacgggcagtgtattactgtgcgagagatcgacatgaacttacggggaaatcgttttagaattccgtacgtcgggggccaaagggggacaccgtgggtaccaacccggttcttccttaacgaacgttccctaccgaacccgaaacggggtccccacgttcccgggttcccttttcccccccgtggggccccgtccccttcgggcccttccccgaacggggtaacccg

SEQ ID NO: 386446 - DNA, 712 bp, Homo sapiens
  misc_feature: GZ8MTXP01A2EZC.22.86.H09.1.454.CMB.2.raw
  modified_base (272)..(272): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggattcaccttnagtggctagtggcatgcacgtggcctcccggccagggccgtccggggacgaagggggctggggaggtggggtggactaaagttatagtgggtatggaatagggaaaaaacttaaagtaagacttaagtggtaggaccttccgggaggaaacgggcccgtaatttccaacctattccctaccgaaagaacgtaaccaaaccgtacccaaaacgtaaacctactttccgttacgggttttaaccctaacccgtaaaattcggaaaaccacggtaccccgttaggaaacggacggggacccgggaaagggtacccgaacggggaacgtaaggtttagggttaaactttaccggttagggtacggaccggaaggttacggtaagttaccggtaaaccgaggttaacgggaaacccggttaacggggggttaaaagttttccggg

SEQ ID NO: 386447 - DNA, 617 bp, Homo sapiens
  misc_feature: GZ8MTXP01COBG5.22.86.H09.1.454.CMB.2.raw
  modified_base (271)..(271): a, c, t, g, unknown or other
  modified_base (279)..(279): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctggggagtccctgagctctcctgtgcagcgtctggatcaccttnagtgctanggcatgcactggcctcccgccgagggcctaccgggaacgagggggtctggggaggtggggtcgacctaaatttagtagtggtataggaatgggaaataaataaaggctagtggtacggacctccggtaggaacgggccgtattccacctatcctacagaacgaccaactaccaaagaacctacttccgtttacgtttaccctacctaaagtcgaaacctacgccgtggaacggacggaccggaacgggaaccgacgggtacttaggttacgttactttacgttggttacggaacggaggtaacggtactaccggaactaacgttaacggtaaaccggg

SEQ ID NO: 386448 - DNA, 575 bp, Homo sapiens
  misc_feature: GZ8MTXP01ERA09.22.86.H09.1.454.CMB.2.raw
  modified_base (544)..(544): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggaggtgggtggcaattatatggtatgaataggaaagtaataaagactaatggtggacctccggtaggaagggccgattcaccatctccagacgaacaactacaaagaacactctcgttctacaaatcgaacaacgcctgagaggcgaggacacggcagtgtattactgtgacgagagatcgacagtgaacggtaacgggaagttcgtttggattcgtcggtacggggaccgaagggacacgtcggtcctaccgtctctcacgccctaccgaccgacgggtcccacgttcccggttcccttccccgnggccccgcccgtgcccgtcgaacggaacccg

SEQ ID NO: 386449 - DNA, 533 bp, Homo sapiens
  misc_feature: GZ8MTXP01AWW9G.22.86.H09.1.454.CMB.2.raw
  modified_base (330)..(330): a, c, t, g, unknown or other
  modified_base (517)..(517): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaataataaagactatgtggactcgtgaagggccatcaccatctccagagacaactcaagaacnctctcgtttcacaaatgaacaagcctgagaggcgaggacacgggcagtgtattactgtgcgagagatcgacatgaacgtacgggaaatcgttttgatcgtacgtggggccaaggggacacgtcggtcctaccgtctcttcacgccctaccaccgaacgggcccacgttccggttcctccccgtggcnccctgcctcgcggccg

SEQ ID NO: 386450 - DNA, 505 bp, Homo sapiens
  misc_feature: GZ8MTXP01APVJX.22.86.H09.1.454.CMB.2.raw
  modified_base (320)..(320): a, c, t, g, unknown or other
  modified_base (333)..(333): a, c, t, g, unknown or other
  modified_base (454)..(454): a, c, t, g, unknown or other
  modified_base (470)..(470): a, c, t, g, unknown or other
  modified_base (482)..(482): a, c, t, g, unknown or other
  modified_base (486)..(486): a, c, t, g, unknown or other
  modified_base (493)..(493): a, c, t, g, unknown or other
  modified_base (501)..(501): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccagcctgggaggtccctgagactctcctgtgcagcgtctggatcaccttcagtggctatggcatgcactggctccgcaggctcgggcaagggctggagngggtgccaattanatggatgatggaaagtaataaagactatgtgaactccgtagaacgggcattcacccatcgtaccaggacacaactaccaaagaacactctatttaccaccaaatgaaccagaccgtgaagngccggaagacacggangtagtattacgngagngagaagnacataagngaag

SEQ ID NO: 386451 - DNA, 497 bp, Homo sapiens
  misc_feature: GZ8MTXP01AW8W3.22.86.H09.1.454.CMB.2.raw
  modified_base (270)..(270): a, c, t, g, unknown or other
  modified_base (308)..(308): a, c, t, g, unknown or other
  modified_base (445)..(445): a, c, t, g, unknown or other
  modified_base (480)..(480): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggatcaccttnagtggctatggcatgcactggctccgcaggctccgggnaaggggctggagtgggtgccaattatagtggtatgatggaaagtaaataaagactatgtgactcgtgaggccgattcacatctccagagacaactccaagaacactctgttacaccaaatgaacagcctagagaggngaaggacacgggcagtgtattacgttgttgcgagngatcgataagttgaacg

SEQ ID NO: 386452 - DNA, 610 bp, Homo sapiens
  misc_feature: GZ8MTXP01EA1NW.22.86.H09.1.454.CMB.2.raw
  modified_base (351)..(351): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtgggtgcaattatatggtatgatggaaagtaaataaagactatgtggactcgtgaaaggcgattcaccatctcagagacaactccaagaacactctcgtttctacaaatnaacaagcctgagaggcgaggacacgggcagtgtattactgtgcgagaacgatcgacatagaacgtaaacgggtaaagtcggttttagtagttcgttcgtagggggacccaaaggggtaccaaacgttcggtaccgtacccggttcttccgtttaacgacgcccctacccgaaacccgaaaccggggtccccttaacggttcccggttcccttccccccgtcggtcccgtccccgtggacccgtccgaacgggtaacccg

SEQ ID NO: 386453 - DNA, 621 bp, Homo sapiens
  misc_feature: GZ8MTXP01AF1PP.22.86.H09.1.454.CMB.2.raw
  modified_base (537)..(537): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggccgtccgggcaaggggctgggaggtggggtggactaattatatggtatgataggaaagtaaataaagactatgtggactccggtagaacgggccgatcaccatctaccagacgaaccaactaccaaagaactacttcttacgtttacctacaaatacgaaacaacgccctggagagggcgaacggacgacggactagttgtattacgtggtagcggagagacacgacagtagaacgtaacgggtaaagttcgttttagacgtccgtacgggtagggtaccgaaggacgtacgtcggtcctaccgttcctcttaaccncgttccctacccgacgaaccgggcccttacggttcccggttccctccccgtggcccgtccccgtcgttccgtccgcggaacccg

SEQ ID NO: 386454 - DNA, 606 bp, Homo sapiens
  misc_feature: GZ8MTXP01BNVBU.22.86.H09.1.454.CMB.2.raw
  modified_base (545)..(545): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcctggggaggtccctgagactctcctgtgcagcgtctggatcaccttcagtggctatggcatgcacgtggcctccgccaggcctccgaggcgaagggggctgggaggtgggtgactaagtttagagtggtaaattggaagtagggaaattaaataaagtctaagtggtaggtacctcggtaggaacgggccgtattacccgactatcctaccgaagacgtaaccaacgtaccaaaggtaactaccttacttcgtttaccctacccaaagttacgaaaccgtcgcccgtaggaacggacgggaacgaagggacgaaccgggngtacggttagttacgttacgttgggtcgcgaaggagaccttaccgggaacttaagtaacgg

SEQ ID NO: 386455 - DNA, 603 bp, Homo sapiens
  misc_feature: GZ8MTXP01CV4PH.22.86.H09.1.454.CMB.2.raw
  modified_base (356)..(356): a, c, t, g, unknown or other
  modified_base (377)..(377): a, c, t, g, unknown or other
  modified_base (402)..(402): a, c, t, g, unknown or other
  modified_base (413)..(413): a, c, t, g, unknown or other
  modified_base (596)..(596): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgcaggcctccgggcgaaggggctgggaggtggggtgcaaattatagtggtatgaataggaaagtaaataaagactagtggtggactccggtaggaacgggccgattcaccatctaccagagaacaacctaccaaagaacncttctcgtttactaccaatanaacaagcctgagaggagagacacgnagtgtattacnggtgacgagagatacgacagtacgaacgtaacgggtaaagttcgttttagacttcggtacggtacggggtaccgaaggacgtaccgtacggtcctacccgttctccttcgaccgttccctacccgacgtaaaccgggcccttacgttccgttcccctcccgtcgcccgtcctcgcgtaaccgnggtcccg

SEQ ID NO: 386456 - DNA, 674 bp, Homo sapiens
  misc_feature: GZ8MTXP01CR5TW.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcagcgtctggattcaccttcagtggctatggcatgcactggcctccgccaggcgtccgggcaagggggctgggaggtggggtggactaattatagtggtatgataggaagtaaataaagactatggtggactcgtagaacggcattcacatctaccagacgaacaactaccaaagaacactcttacgttactacaatacgaacagcctgagaggacgagacacggcagtgtatacgtagtgacgagagatacgaagatacgtaacgtaacggggtaaagttcgttttagtacgttacgttacggtacgggggaccgaaacggggtctaaccgtcgggtcccgtaacccggttccttccttaaccgcgttaccccgtaccccgaaccgggtaaacccgggtccccgttaaaccgtttccccgggggttccccctttccccccccggggttcgggcccccgttcccccggtcggttccccgttaaccccggaacgggggtaacccccg

SEQ ID NO: 386457 - DNA, 552 bp, Homo sapiens
  misc_feature: GZ8MTXP01BGUD8.22.86.H09.1.454.CMB.2.raw
  modified_base (385)..(385): a, c, t, g, unknown or other
  modified_base (511)..(511): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagactctcctgtgcagcgtctggatcacttcagtgctatggcatgcacgtggcctccgccgaggccgtccgggcgaagggggctgggagtggggtgacctaattagtagtggtatgaagtgggaaagtaaataaagctagtggnggtacctccggtagaacgggccgattcgacattccacagacgaaccaactacaaagactactcttagttacctacaaatgaacagcctagagaggcggaaggacgcggcttagttcgtaattacgnggttacgcggtagaacgatcggacctgttaacgtaaccggg

SEQ ID NO: 386458 - DNA, 623 bp, Homo sapiens
  misc_feature: GZ8MTXP01DTV9F.22.86.H09.1.454.CMB.2.raw
  modified_base (227)..(227): a, c, t, g, unknown or other
  modified_base (312)..(312): a, c, t, g, unknown or other
  modified_base (410)..(410): a, c, t, g, unknown or other
  modified_base (560)..(560): a, c, t, g, unknown or other
  modified_base (607)..(607): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggnaaggggctggaggtgggtgacaattatatggtatggataggaaataaataaagactatgtggactcgagaaggcgatcaccatcncagacgaacaactaccaaagaactactcttacgtttacctaaccaaagtacgaaactaaacgaccgtggaaggaacggggacgaacggacgacggggnaaaggttgttaagttacgtgtacggcgaaggaagtactacggaacagtacggaacgttaaacgggggaaattcggttttaggaacgttccgtacgggtacggggaacccgtaagggacctaaccgtcggtacctaccgtctctaacgacncccgtaccgacgaaacggcccacgttcgttccctcccgtcgcctccngacctcgcgtaacccg

SEQ ID NO: 386459 - DNA, 822 bp, Homo sapiens
  misc_feature: GZ8MTXP01CIRZN.22.86.H09.1.454.CMB.2.raw
  modified_base (276)..(276): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtggggacgtccctgacgctctcctgtgcagcgtctggactcaccttnagtggctagtggcatcgcacgtggcctcccgcgaggccgtccgggacgagggggtctgggcggtgggtcggacctaagtttatagtggtatagtaagtaagggaaagttaaaactaaagggtactagtacgggttacggtaacccgttacccgggtagggaaaccggggtcccgtaacgttttaccccgaaaccccgtactttaccccgtaacccgaaacgggtaaaccgtaaaccccgaaaacccttaaaccccgaaaaacggtaaaccccgtttaaacccctttaccggtttttaaacccggttttaaacccctaaaaccccgttaaaaaagtttcccggaaaaaaccccgttacgggacccccgttaaagggggaaagggtaaccgggggaaccggtaaaaccggggtaacccgaaaccggggggtaccttaaggggttttaaaccggttaagttttacccggttaagggttccgggtaaccgggtaaggaacggtaacgttcccgggaaacttaacgggttaacgggtttaaaacccggggg

SEQ ID NO: 386460 - DNA, 630 bp, Homo sapiens
  misc_feature: GZ8MTXP01A0QHF.22.86.H09.1.454.CMB.2.raw
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcctgagactctctgtgcagcgtctggattcgacttcagtggctagtggcatgcacgtggcctccgccgaggccgtccgggacgagggggctgggaggtgggtgactaagtttatagttggtatggaagtagggaaaaaacgttaaataagactaagtgggtacggaccttccgggtagggaaacgggtcctattaccgacctacgtcctaccgaagaacgaacctaaaccgtaccaaacgtaacctacttaccgtaggttttacctaaccgaaatacgaaactacgaccgtaggaacggacggaccgaaggtaccgaacgggctaggttgttaagttcgaggtcgagttagaggtaatccggaatacgtacggaacgtaacgggttaacgtttcg

SEQ ID NO: 386461 - DNA, 623 bp, Homo sapiens
  misc_feature: GZ8MTXP01DTBUG.22.86.H09.1.454.CMB.2.raw
  modified_base (189)..(189): a, c, t, g, unknown or other
  modified_base (228)..(228): a, c, t, g, unknown or other
  modified_base (348)..(348): a, c, t, g, unknown or other
  modified_base (355)..(355): a, c, t, g, unknown or other
  modified_base (374)..(374): a, c, t, g, unknown or other
  modified_base (398)..(398): a, c, t, g, unknown or other
  modified_base (430)..(430): a, c, t, g, unknown or other
  modified_base (614)..(614): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggcctccgcaggctccgggngaaggggctgggaggtggggtgactaagttatagtggtatggaataggaaagtaaataaacgatatggacgacctcggtggaaaggcctatccaccatcaccaagacaacaactacaaanaacactntcgttacacaaatcaaacncgctgaggagacgagtacgacggntagtatattacgtgcgagagagactacggaanacgtacgaacgtaaacgggtaaattcgtttaggtactcgtcggacggggacccgaaaggggacctacgtcggtaccctaacccggttccttacgttcccaacgttcccctaacccgacccgaaccgggtcccttaaccgttcccggttcccttccccggcgcccgtccctcggactaaccccgngggaacccc

SEQ ID NO: 386462 - DNA, 557 bp, Homo sapiens
  misc_feature: GZ8MTXP01ATZSM.22.86.H09.1.454.CMB.2.raw
  modified_base (524)..(524): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaagtaataaagactatgtggactcgtgaagggccgattcaccatctccagagacaactccaagaacactctgtttctacaaatgaacaagcctgagaggcgaggacacggcagtgtattactgtgcgagagatacgacatgaactagggaaagtcgttttggattcgtcgtggggaccaagggcacgtggtccaccgtctcttcacgttccctccgaccgaaacgggccccagttcccgggttccctttccccccgnggcccgcccctgacccttccgaacgggtaaccg

SEQ ID NO: 386463 - DNA, 681 bp, Homo sapiens
  misc_feature: GZ8MTXP01EF4J7.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggacgtcctgacgactctcctgtgcagcgtctggactccacttcgagtggctatggcatgcacgtcggcctccgcgacggtcgtcccggggacgagggggtcgtggaggtgggtgactaattagtagtggtagtgaagtggaaataaagtaaagtactagtggtacggtaaccgtcggtaggaacgggccctaacttaccgaacctacgtacctacgaagaaccaaccaaccctacgaaaactaacctaactttctttacgtttaccaaaccaaagtccgaaacgtaacgtccgtaaggaacggaacggggaccgtaacgggaacccgaacgggtaccgttaaacggttggtttaaaccgtttcgggtttaggaccgggaacggggtaaaggaaacggtttcgaaacccggggttaccttaaagggttaacccggggtttaaaaacccgggg

SEQ ID NO: 386464 - DNA, 667 bp, Homo sapiens
  misc_feature: GZ8MTXP01BO7XS.22.86.H09.1.454.CMB.2.raw
  modified_base (434)..(434): a, c, t, g, unknown or other
  modified_base (630)..(630): a, c, t, g, unknown or other
  modified_base (638)..(638): a, c, t, g, unknown or other
  modified_base (644)..(644): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggctccgggcgaaggggctgggaggtgggtggactaattatagtggtatgataggaaagtaaataaagtactagtggtaggaccgtccggtaggaaacgggccgtattaccaccatcctaccaagaacgaacaacctaccaaacgaacctacttcttacgtttacctaacaaagtacgaaacaacgacctggagaacgggcgaacggacgacggntagtagttacttacgtgtgacgagtaagactacgaacagtacgaacgtaaaggggtaacttcgttttagacgttccgtacgggtcggggaaccaaggggtacctaacggtcgtaccgtacccgttctccttaaccgacgttccccgtaccgaaaccggaaccggtccccttacggttcccggttccccttccccgnggtccccncccgtnacccgtaaccgaacgggaacccg

SEQ ID NO: 386465 - DNA, 654 bp, Homo sapiens
  misc_feature: GZ8MTXP01AFHOR.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggcaaggggctgggagtggggtgcaattatagtggtatgataggaaagtaataagactatgtggactcgtgaagggccgattcaccatctaccagagacaactccaaagaacactctcgtttaccacaaatgaacaacgcctgagaggcgaggacacggcagtgtatactgtcgacgagagacgtcgacagtacgaacgtacgggtaaaggtcgttttagaacgttccgtacggtacgggggacccgaaagggggacctaacggttcggttacccgtaccggtttcccttccgtttaaccgaacgccccgttaaccccgaaaccccggtaaaccgggggtcccccttaacggtttccccgggttcccctttcccccccggttcggggtccccgtcccccgttcgccccgttcccgaacgggtaaccccgg

SEQ ID NO: 386466 - DNA, 651 bp, Homo sapiens
  misc_feature: GZ8MTXP01BL1OG.22.86.H09.1.454.CMB.2.raw
  modified_base (421)..(421): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggcgtccgggacgaaggggctgggaggtggggtggactaattatagtggtatggataggaaataaataaagactagtgtaggactcgtaggaacgggccgtatcacctatctaccgaagacgaaccaactaccaaagaactactcttacgttaccaacaaatgaaacacgcctgagaggcgaaggacacggactagtatattacnggtacgacgaagagtactacgacagtacgaacgtaacgggaaagttcgtttagattcggtacggtacggggaccgaagggacctaacggtcgtaccgtacccgtcttccttaaccgccgttacccctacccgaaacccggtaaccgggtccccttacggttccccggttccccttcccccggtcgggccccgtccccgttcggacccgttaacccgaacgggtaaccccg

SEQ ID NO: 386467 - DNA, 530 bp, Homo sapiens
  misc_feature: GZ8MTXP01BFKK3.22.86.H09.1.454.CMB.2.raw
  modified_base (267)..(267): a, c, t, g, unknown or other
  modified_base (275)..(275): a, c, t, g, unknown or other
  modified_base (306)..(306): a, c, t, g, unknown or other
  modified_base (365)..(365): a, c, t, g, unknown or other
  modified_base (378)..(378): a, c, t, g, unknown or other
  modified_base (459)..(459): a, c, t, g, unknown or other
  modified_base (491)..(491): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctctgtgcagcgtctggatcactnagtgctanggcatgcactggcctccgcaggcgtccgggngaagggggctgggaggtcggggtggacccaattatagtggtatagaatgggaaataaanaaagtactagtgngactcgtgaaggcatcacatctcagacaacaactacaaagactactcttgttaccaacaaatcgaacaagcctagaacggnggccgaaggacagggcaggttagtacttacgngttagcgagaagacgtaccaagtaacgttaacgaaacgg

SEQ ID NO: 386468 - DNA, 567 bp, Homo sapiens
  misc_feature: GZ8MTXP01EZ584.22.86.H09.1.454.CMB.2.raw
  modified_base (231)..(231): a, c, t, g, unknown or other
  modified_base (341)..(341): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaangcaccaggcaaacgcccccagactcatcatttatgctgtcaataagcggcccctcgaggggtcccctgactcgcttctctggctccaagtctggcaaccacggcctcccngacccaatctcgtcgggcctccgaggctagaagatgaggctgtattattactgctgctcatttgcacggcgcctacgtaccgtttggggtggttccgggcggacgggaacccaaggtcctcggacccgtccgtaagggtccacggccccgaagggccctccgttcccccgttcgggttccctaaccgttcgttcccggttcccccgccccttcctccgccggttcg

SEQ ID NO: 386469 - DNA, 554 bp, Homo sapiens
  misc_feature: GZ8MTXP01DGPVT.22.86.H09.1.454.CMB.2.raw
  modified_base (315)..(315): a, c, t, g, unknown or other
  modified_base (499)..(499): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggacgtccctgagctctcctgtgcagcgtctggatcaccttcagtggctagtggcatgcactggcctccgccaggccgtccgggngaagggggctgggaggtggggtgacctaattatagtgggtatagatgggaaataaactaaagactagtggtagaccgtcgtagaacgggcgatcaccatctaccagacgacaactacaaagaactactcttagttacctaccaaagtcgaacacgtcctagaggacggacggaaggtacacggnaggtagtacttacgttgttagccggaagcgagtacgactaagttaacggtaacgg

SEQ ID NO: 386470 - DNA, 616 bp, Homo sapiens
  misc_feature: GZ8MTXP01AJQO3.22.86.H09.1.454.CMB.2.raw
  modified_base (277)..(277): a, c, t, g, unknown or other
  modified_base (399)..(399): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtggggacggtcccctgacgactctcctgtgcagcgtctggatcaccttnagtggctagtggcatgcacgtcggcctccggaccgaggccgtccggggacgaagggggctggggaggtggggtcggacctaagttagtagtgggtataggaagtgggaaagtaaataaacgntagtgtcggaactccggtagaacgggtcctaattccaacactcctaccaaggacaaccaactacccaaagtaaccgtactcgtttactttacccaaccaaagttcgaaacgtacgcccgtaggacggacgggccggaacggacaacgggtcaaggttcggttaattcgttggacggaacggagtaacgactaccggactaaggttcggtaaaccggg

SEQ ID NO: 386471 - DNA, 662 bp, Homo sapiens
  misc_feature: GZ8MTXP01BHB0J.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattatatggtatgatggaaagtaataaagactatgtggactccgtgaagggccgatcaccatctccagagacaactccaaagaacactctgttctacaaatgaacaagcctgagaggcgaggacacggcagtgtattacagtgacgagagatacgacatagaacgtaacgggaaacgttcgttttaggaagtttccgtacggttacgggggacccgtaaacgggggacctaaaccggttcggttacccgtaaacccggttcccgttcctttaacccgaaccggttccccttaccccgaaaccccggaaaccgggggtcccccttaaacggtttcccggggttacccccttttcccccccggcggggttccccgccccccgtttagggaccccttcccgaacgggggtaaccccg

SEQ ID NO: 386472 - DNA, 590 bp, Homo sapiens
  misc_feature: GZ8MTXP01CU7Y9.22.86.H09.1.454.CMB.2.raw
  modified_base (343)..(343): a, c, t, g, unknown or other
  modified_base (402)..(402): a, c, t, g, unknown or other
  modified_base (433)..(433): a, c, t, g, unknown or other
tcagacatacgcgtcacgaccggtgctcgatttagtgctatagacttgggtttgggctgagcgtggtttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggacaagggggctgggaggtggggtggactaattatatggtatgatggaaagtaaataaagactatgtggactcgtgaacggcgattcacatctccagacgaacaactacaaacgaaacnctcttcgtttaccacaaatcgaaacaacgcctaaggagacgggacgacggacgacggtnagtgttaattagtgagagaagagatacgaanagtacgaacgtaaacgggtaattcgtttagacgttcgtacgggacgggaaccgaaaggacgtacggtcgtacctaccgtctcctcaccgttcctacccgaacgtaccggccttacgttcccgttccctccccgtcgcccgcctcgcctccgcggccg

SEQ ID NO: 386473 - DNA, 624 bp, Homo sapiens
  misc_feature: GZ8MTXP01BEJLP.22.86.H09.1.454.CMB.2.raw
  modified_base (328)..(328): a, c, t, g, unknown or other
  modified_base (376)..(376): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaaggggctgggagtggggtgcaattatatggtatgatggaaataataaagactatgtggactcgtagaggcattcacatctcagagacaactcaaagaacnctcttcgttacacaaatgaacagcctgagaggacgagacacggcagtntatactgtgacgagagatcggacagtacgaacgtaaacggggtaaagttcgttttaggacgttaccgttcgggtacgggggtacccgaaaggggtaccgtaacgttcggggtacctaacccggttcctccgttccgaacggttccccttacccgaaaccggaaaccggggtccccttacgttccccggggttccccttcccccggtcggccccgtccccgttcggcccgtccgaacggggtaaccccg

SEQ ID NO: 386474 - DNA, 560 bp, Homo sapiens
  misc_feature: GZ8MTXP01CN3X9.22.86.H09.1.454.CMB.2.raw
  modified_base (233)..(233): a, c, t, g, unknown or other
  modified_base (337)..(337): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagccacccaggccaaacgcccccagactcatctattatgctgtacaataacgcggcccctcgacggggtccctgactcgcttctctggctcagtctggcaaccncggcctcctgaccaatctcgtgggctccgagctagagagtgaggctagtattatactgctgctcattgcaggccgctacgtcgttgggtggttcggcggacggaccaaggtccgtaggacccgtctaacgggtccacggacccgaacgggtccctccggccccccgttggttaccctaaccgttcccttcccgttcccccacccttccctccgttaaccgtcg

SEQ ID NO: 386475 - DNA, 606 bp, Homo sapiens
  misc_feature: GZ8MTXP01AXFRE.22.86.H09.1.454.CMB.2.raw
  modified_base (253)..(253): a, c, t, g, unknown or other
  modified_base (331)..(331): a, c, t, g, unknown or other
  modified_base (383)..(383): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattanatggtatgatggaaagtaataaagactatgtggactccgtgaaggccgattcacatctccagagacaactcaagaacnctctcgttcacaaatgaacaagcctgagagcgagacacgggcagtgtatacngtgcgagagatcgacatagaactacgggaaagtcgtttagatcgtacgtcggggaccgaaaggggaccaacgtggtccctaaccggtccttaccttcgaaaccggttcccttaccccgaaacccgaaaccgggggtcccccttaacgttccccggggttcccctttccccccccggtgggccccgtcccccgttcggccccgttcccgaacgggtaaccccgg

SEQ ID NO: 386476 - DNA, 717 bp, Homo sapiens
  misc_feature: GZ8MTXP01AW2VD.22.86.H09.1.454.CMB.2.raw
  modified_base (249)..(249): a, c, t, g, unknown or other
  modified_base (269)..(269): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagctctcctgngcagcgtctggatcaccttnagtggctatggcatgcactggctccgccaggcctccggggcaagggggctgggacggtggggtgcctaaattagtagtggtatggaagttgggaaaagttaaacgtaaaagtacgttaagttgggtacgggtaccgttacccggtaggaaacggggacccgtaatttacccgaacccttaatcccttaccccgaagggaaacgaaacccaaacccgttaccaaaacggtaaacccgttaaccctttaccggtttacgttttaacccttaaaccaaaaacgttacaaaaccgaacgttacccgtagggaaagggaaccggggacgggaaacgggaaccgttaacccggggaacgttagggttaacggttaatttaaacccgttcgggttacgggaacggaaggtaacgggaattacccggaacgtaagttaacgggttaaaacccgggg

SEQ ID NO: 386477 - DNA, 670 bp, Homo sapiens
  misc_feature: GZ8MTXP01A1HR9.22.86.H09.1.454.CMB.2.raw
  modified_base (255)..(255): a, c, t, g, unknown or other
  modified_base (306)..(306): a, c, t, g, unknown or other
  modified_base (309)..(309): a, c, t, g, unknown or other
  modified_base (413)..(413): a, c, t, g, unknown or other
tcagacatacgcgtcacgaccggtgctcgatttagtgctatagacttgggtttgggctgagctgggttttcctcgttgctctttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtggggtgcaattatntggtatgatggaaagtaataagatatgtggactcgtagaaggcattcaccntcnccagacacaactccaaagaactactcttcgtttacctacaaatagaacaagtcctggagacgggacggaacggacgacgggactaggtattagttaccttgggnggacgagaacgacgtacgacgtacgtacgtaacgttaacgggtaacgtttcggtttacgacgttccgtaccgggtacggggaaccggtaaacgggtaccgtaacgttcggtaccctacccgttcctcccgttaaccgaccgttaccccgtaccccgaaacccgggtaacccgggtccccgttacccggttccccggttcccccgttccccggtcggtccccgtcccgtccgttacccgtaaccgaacgggtaacccg

SEQ ID NO: 386478 - DNA, 664 bp, Homo sapiens
  misc_feature: GZ8MTXP01AM6WX.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggccgtccgggcgaaggggctgggagtggggtgactaattatagtggtatgataggaaagtaaataagactagtgtggactccggtagaacgggccgtattcaccatctaccagacgaacaactaccaaagaacacttctcgtttacacaaatacgaacaagcctgacgagggacgaggacgacggacagtgtattacgtggtagacgtagagactacgaacagtacgaacgttaacggggtaaagttcgttttagacgttccggttaccggtacgggggaacccgaacggggtaacctaaccggtcggtaccctacccggttccttaccgttcgaccgttcccctaacccgaaccggtaaccgggtccccttacggttccccggttccccgttcccccgtggtccccgtcccgtcggttacccgtaacccggaacgggaacccg

SEQ ID NO: 386479 - DNA, 618 bp, Homo sapiens
  misc_feature: GZ8MTXP01D1IWG.22.86.H09.1.454.CMB.2.raw
  modified_base (407)..(407): a, c, t, g, unknown or other
  modified_base (584)..(584): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggccgtccgggcgaaggggctgggaggtggggtggactaattatagtggtatgataggaaagtaaataaagatatgtggactcgtgaaggccgattcacatctacagacacaactacaaagaacactcttacgtttacacaaatcaacaacgctgagagggacgaggacacgggctaggtgtattacgngtgacgaagaagatacgaacagtacgaacggtaaacgggaaagttcgttttagacgttccgtacgggtacggggaacccaaggggacctacgtcggtaccaccggttcctcgttccaacgttccctacccgaaccggaaaccgggtcccttacgttcccggttccccttcccccggnggcccgtcccgtagcctaaccggaacggaacccg

SEQ ID NO: 386480 - DNA, 657 bp, Homo sapiens
  misc_feature: GZ8MTXP01DWEVH.22.86.H09.1.454.CMB.2.raw
  modified_base (337)..(337): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggaggcgtggtccagcctgggaggtccctgagactctcctgtgcagcgtctggattccaccttcagtggctatggcatgcactggctccgccaggctccgggcgaaggggctgggagtggggtgacaattatagtggtatgataggaaagtaaataaagactatgtggactcgtaggaaggccatcaccatctcagagaacaactaccaaanaacactcttcttacacaaatgaaacaacgcctgagacgggacgaggaacacgggctagtgttatactgtgacgagagtacgtacgaacatacggaaacgtaacggggtaaattcggttttaagaacgttccgttacgggtacggggaacccgaaaggggtacctaacggtcgggtaccctaaccggttccttccgttaaccaaccgttccccgtaccccaaaccggaaaccgggtccccttaacggttccccggtttcccccgtttccccccgcgggtccccgtcccccgtggttcccctaacccggaacggtaaccccg

SEQ ID NO: 386481 - DNA, 554 bp, Homo sapiens
  misc_feature: GZ8MTXP01BEQBB.22.86.H09.1.454.CMB.2.raw
  modified_base (455)..(455): a, c, t, g, unknown or other
  modified_base (488)..(488): a, c, t, g, unknown or other
  modified_base (545)..(545): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggcctccgccaggctccgggcaaggggctgggagtgggtggacaattatatggtatgatggaagtaaataaagactatgtggactcgtgaaggccgatcaccatctccagagacaactaccaaagaacactctcgtttcacaaatgaacaagcctggagaggcgaggacacgggctagtgtattactagtgacggagagatcgaacagtagaacgtaacgggtaaagtcgttttagacttcgtcgnggggaccaagggacacgtgtcctacgtctctcncgccctccaccgacggcccacgttccggttcctccccgtgcccgtccctcgcctcgnggtaacccg

SEQ ID NO: 386482 - DNA, 639 bp, Homo sapiens
  misc_feature: GZ8MTXP01CB2OV.22.86.H09.1.454.CMB.2.raw
  modified_base (239)..(239): a, c, t, g, unknown or other
  modified_base (273)..(273): a, c, t, g, unknown or other
  modified_base (366)..(366): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaanagcaccaggcaaacgccccagactcatcatttangctgtacaataacgcggccctcgacggggtccctgactcgtcttctctggctcaagtctcggaccaacgaccggtccctcccgtacgaccctntcctcgtcggggcctaccgagggtctaggaaacgtagtggaaggtcttaggtaatttaacttacgtggtctgtcttacgtagtttcggcggtaacgggtcccgtacccgttaacgtacggtttcgggggtcggtttccgggggaccgggtacgggaaccctaaggtccgtcggtaaccccggttcgttacgggtcccacggaccccgtagggccgttcccggcccccgttggtacctccgttcccgttccggttcccctcccttcgtaacccg

SEQ ID NO: 386483 - DNA, 910 bp, Homo sapiens
  misc_feature: GZ8MTXP01BM09L.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcgaaggggctgggaggtggggtgactaaattagtagtggtatggaagtaggaaagtaaataaagactaagtgtggactccggtaggaacgggtccgattaccaacctagtctacccgaagtaacgaacctaaacctacccgaaaagtaaacctacttccttacgttttacctaaaccaaaaagttacgaaaacccgtaacggtacccgttaagggaaacgggtaaacggggaacccgggaaacggggtaacccgaaaccggggggtaccttaaagggtttaaggtttaacgttttaaaccggttacgggttagggtaacccgggaaagggtaaacgggtaaccgttaaccggaaacccggtaaaggttaacggaaaccggttaaacccgggggttaaaaggttccggttttttaagggaaccgtttaccggttaaccggggttaccgggggtaaccccggaaaaccgggggtaccgtaaacccggttcggtaaccccgtaacccggtttccttccccgtttaaccggtaacccgttacccccggttaaccccgaaacccgggtaaacccggggtaccccgttacccgtttccccggggttccccccgtttaacccccccggtccgggtcccccggttccccccgtcggttacccccgtaacccggttaaccgggtaaccccgg

SEQ ID NO: 386484 - DNA, 606 bp, Homo sapiens
  misc_feature: GZ8MTXP01A97OZ.22.86.H09.1.454.CMB.2.raw
  modified_base (262)..(262): a, c, t, g, unknown or other
  modified_base (276)..(276): a, c, t, g, unknown or other
  modified_base (548)..(548): a, c, t, g, unknown or other
  modified_base (570)..(570): a, c, t, g, unknown or other
  modified_base (584)..(584): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagctctcctgtgcagcgtntggacttcaccttnagtggctagtggcatgcacgtcggcctcccgccgaggccgtccgggagaagggggctgggaggtgggtgactaagttagtagtggtatgaagtaggaaaaattaaagtaagcttaagtggtacggacctccgggtaggaaacgggcctaattccgaacctacttccacccgaagaccgaaccaaacccgtaccaaacgaacctactttccttacggtttacccaacctaaagtacgaaacacgtccgtaggaacggacggaccggacgacgnggctagttgtacttagtgacgngagagaatcggaanagtacgacgtaagggaatttcg

SEQ ID NO: 386485 - DNA, 779 bp, Homo sapiens
  misc_feature: GZ8MTXP01AB5VI.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtggggacgtccctgagaccttctcctgtgcaggcgtctggatccaccttgagtggctagtggcagtgcctacgtcgggccctcccggccgacggggccgtacccgggggacggaacggggggtcttagggggaggttgggggtacggaaccttaaagtttagtagttgggtaatagggtaagttaacgggtaaaagttaaaacgtaaaagtacttaaggttcgggtacgggtaacccgttcccgggttaagggaaaccgggggtacccgtaagtttaccccgaacccgtaaacttcccgtaacccggaaagggtaaaccgaaacccctaaaacccgttaaccccgaaaaacggtaaacccgttaacctttaccgtttaccggtttaacccttaaacccaaaagttcgaaaacctacggtcccgttagggaaacggaacggggcggaaacgggtaacgaccggggtacttaaggttacgttaagtttaccggttggttacgggaacgtaggaacgtaacgtccggaataacggttaacggtaaaacccgggg

SEQ ID NO: 386486 - DNA, 653 bp, Homo sapiens
  misc_feature: GZ8MTXP01A2YV0.22.86.H09.1.454.CMB.2.raw
  modified_base (200)..(200): a, c, t, g, unknown or other
  modified_base (224)..(224): a, c, t, g, unknown or other
  modified_base (239)..(239): a, c, t, g, unknown or other
  modified_base (264)..(264): a, c, t, g, unknown or other
  modified_base (275)..(275): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccngcagtgatgttggtgttataactntgtctctgtaccaangccaccaggacaaacgccccagacncatctatttangctgtacaagtacgccggccctgacggggtcccctgactcgtctttcgtcgtcggcctaccgaagtcgtacggaccaacgaccggtccctcccgtaagaccctgtcctcgtcgggcctccgaggtctagaacgtagtggacggtcttaggtaatttacgtacgtgtactcgcttacgtagtttcggacggtacgggtcctaccgttacgttacggttcggggtacgttccggggacgggtaacggtacctaacggtccgtacggtaaccccgttcggttaggtaccgacggtaccccgtaaggttcccgttacccggttcccccgttggtacctaaccgttcccgtcccggttacccctaacccgttccgttaaccgg

SEQ ID NO: 386487 - DNA, 514 bp, Homo sapiens
  misc_feature: GZ8MTXP01E02JZ.22.86.H09.1.454.CMB.2.raw
  modified_base (331)..(331): a, c, t, g, unknown or other
  modified_base (356)..(356): a, c, t, g, unknown or other
  modified_base (411)..(411): a, c, t, g, unknown or other
  modified_base (481)..(481): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagttttgggctgagctgggttttcctcgttgctcttttaagaggtgtccagtgtcaggtgcagctggtggagtcgtgggggagcgtggtccagcctggggagtccctgagactctcctgtgcagcgtctggattcaccttcagtggctatggcatgcactggctccgccaggctcgggnaggggctggaggtggtgcaattaanagtgtatgatggaaagtaataaagctagtgtggactcgtgagggcgattcaccanctcagagaacactaccaagaacactctgtttcaccaaatcgaacacgcctgagagggcgaggacacggcngttgtaattcgtgtggacgagaacgaagtaacg

SEQ ID NO: 386488 - DNA, 592 bp, Homo sapiens
  misc_feature: GZ8MTXP01ADIH5.22.86.H09.1.454.CMB.2.raw
  modified_base (381)..(381): a, c, t, g, unknown or other
  modified_base (404)..(404): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctggagtgggtgcaattatatggtatgatggaaagtaataaagactatgtggactccgtgaagggccgatcaccatctccagagacaactccaaagacactctgtttcacaaatgaacaagcctgagaggcgaggacacggctagtntattacgagtgcgagagatcganagtgaacgtaacgggaaagtcgttttagagttcgtacggtacggggaccgaaggggtacacgtcgggtccaccggttcttccttcaccgccctacccgaaccgtaaccgggtccccttacggttcccggttccccgttccccccgtgggtccccgtccccgttgccccgttccgaacggggtaacccg

SEQ ID NO: 386489 - DNA, 563 bp, Homo sapiens
  misc_feature: GZ8MTXP01CQS3R.22.86.H09.1.454.CMB.2.raw
  modified_base (322)..(322): a, c, t, g, unknown or other
  modified_base (386)..(386): a, c, t, g, unknown or other
  modified_base (542)..(542): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcgtccgggcaaggggctgggagtggggtgactaattatagtggtatgaataggaaataaataaagactatgtggactcgtagaacggcgatcacatctcaganaacaactcaaagaacactctcgttacacaaatcgaacaagcctgagagacgagacacggcagtntatactgtgacgagagatacgacagtagaacgtaacgggtaaagttcgtttagagttcgacggtaggggacccaagggcctacgtcggtcctaccgtctcttcacgcctaccgacgaacggcccttacgttcccgttacccttccccgcggtcccnccgtcgcctccgaacggaacc

SEQ ID NO: 386490 - DNA, 623 bp, Homo sapiens
  misc_feature: GZ8MTXP01DZCH5.22.86.H09.1.454.CMB.2.raw
  modified_base (232)..(232): a, c, t, g, unknown or other
  modified_base (598)..(598): a, c, t, g, unknown or other
  modified_base (603)..(603): a, c, t, g, unknown or other
  modified_base (607)..(607): a, c, t, g, unknown or other
  modified_base (617)..(617): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattccaccttcagtggctatggcatgcactggcctccgccaggccgtccgggngaaggggctgggaggtggggtggactaaattatagtggtatgaataggaaagtaaataaagtactagtggtggacgtcgtaggaagggccgtattcaccatctacagaacgaacaactaccaaagaactctcttcttaccacaaatcgaacaacgctggagacgggacggaacggacgacggctagttgttaattacgtggacggacgtaagacgtacgtacgaacagtacgtaacggtaaacgggaaactttcgtttagacgttccgttacgggacggggacccgaaagggcctaacggtcgtacctacgtctcctcacgccctaccgaccgtaacggcccttacggttccgttcccttccccgngcccncccngcctaaccgnggtccc

SEQ ID NO: 386491 - DNA, 808 bp, Homo sapiens
  misc_feature: GZ8MTXP01CA6E7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggcctccgccgaggccgtccgggacgaaggggctgggaggtggggtgactaattatagtggtatgaataggaaagtaaataaagactagtggtacggacgtacggtaggaaacgggccgtaattccacctatcctaccaagaacgaaccaaactaccaaagaacctacttacttaccgtttacctaaccaaaatacgaaacaacgtaccgtaaggaaggaacgggacggaacgggaaccgacggggactaagggttagttaactttacggtaggttacggacggtaaggaaggtaacgtaccggaaacgtagttaacggtaaaccggttaaacgggtaaacgtttcggttttacggtaacgtttccgtacgggtacgggggaacccgtaaacggggtaccgtaccgttacgggttaccctaacccggtttccttcccgttaaccgaacccggttacccccgttaaaccccggaaacccggtaaacccgggggtccccttaacccgggtttccccgggttacccccgtttcccccccgggtcgggtcccccgttccccgtaccggttaccccgtaaccccgggttaacggggtaaccccg

SEQ ID NO: 386492 - DNA, 541 bp, Homo sapiens
  misc_feature: GZ8MTXP01CJG14.22.86.H09.1.454.CMB.2.raw
  modified_base (516)..(516): a, c, t, g, unknown or other
  modified_base (522)..(522): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggctaattatatggtatgataggaaagtaaataaagactatgtggactccgtagaaggccgattcacatctccagagacaactccaagaacactctgtttccacaaatgaacagcctgagaggcgagacacggcagtgtatactgtgacgagagatcgacatagacgtaacgggaattcgtttgatcgtacgtgggacccaagggactagtggtcctacgtctctctcgcctaccgaccgaacgggcccttagttccgttccttccccgnggcccncctcgcctccgaaggtccg

SEQ ID NO: 386493 - DNA, 572 bp, Homo sapiens
  misc_feature: GZ8MTXP01DYIJX.22.86.H09.1.454.CMB.2.raw
  modified_base (359)..(359): a, c, t, g, unknown or other
  modified_base (385)..(385): a, c, t, g, unknown or other
  modified_base (390)..(390): a, c, t, g, unknown or other
  modified_base (394)..(394): a, c, t, g, unknown or other
  modified_base (397)..(397): a, c, t, g, unknown or other
  modified_base (493)..(493): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcacttcagtggctatggcatgcactggctccgcaggctccgggcaaggggctgggagtgggtgcaattatagtggtatgataggaaagtaaataaaagatatgtaggactccgtgaaagggccattcacccatctccagagaacaactcaaagtaacactcttcgttactacaaatnaacaagcctgagagcgagacacgggntagtntatntgngagagagactacgacagtacgaacgtaaaggtaagttacgtttagtacgtcgtacggtacgggaacgaacggactacgtcgtactccgttctctcnccgttccctaccgaaccgaccggcccttcggttcccgttcccgtccccgtcgccgtcccgtcgccgtaaccgcgaaccg

SEQ ID NO: 386494 - DNA, 635 bp, Homo sapiens
  misc_feature: GZ8MTXP01ADWK7.22.86.H09.1.454.CMB.2.raw
  modified_base (435)..(435): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccgaggccgtccgggcaagggggctgggaggtgggtggactaattatatggtatgataggaagtaaataaagactaatggtggacttccgtaggaaggccgattcaccatctccgagagaccaactaccaaagaacacgtcttacttactacaaatagaacaacgcctgacgaggcgaggacacggcagtagtaacttagtgtgacgagaagagtccgaanagtacgaacgtaaacgggtaaacgttcggtttacggaattcgtaccggtcgggggacaacgggggactaacgtcgtccgaccgttctaccttcaacgcctacccgaacccgtaacggggtccccttcgttccccggttacccgttccccccgttggggaaccccctcccggtaccgttccggtcccgaaacggtccccgg

SEQ ID NO: 386495 - DNA, 597 bp, Homo sapiens
  misc_feature: GZ8MTXP01AW9HZ.22.86.H09.1.454.CMB.2.raw
  modified_base (429)..(429): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcgaaggggctgggagtggggtgcaattatatggtatgataggaagtaaataaagactatggtggactccgtaggaacgggccgattcaccatctacagagaacaactaccaagaacactctcgttactacaaatcgaacaagcctgagagggacgaggacacggacagtacgtattacgtggtggacgaggagataccgaanagttagaaccgtaaggggtaaagtcgttttaggacttcgtaccggtcgggggacctaagggggacacgttggtcctaccgttctaccttcaacgttccctacccgaccgaacgggccccacgttccgttcccttcccccgtggccctcccgtgccctccgcgggaacc

SEQ ID NO: 386496 - DNA, 605 bp, Homo sapiens
  misc_feature: GZ8MTXP01AVT8N.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtgcaattatatggtatgatggaaagtaaataaagactatgtggactccgtgaagggccgattcaccatctccagagacaactccaaagaacactctcgttctacaaatgaacagcctgagaggcgagacacggcagtgtattacgtgtgcgagacgatcgacatgaacgtaagggaaatcgttttagacttcgtcgtacgggggccaaaggggacctaacgtgggtacctacccggttcctcgttaaccacggttccccttacccgaacccgaacggggaccccttacggttcccggttccccgttccccccgttcgggccccgtccccgtcggttccctaacccgaacggggtaaccccg

SEQ ID NO: 386497 - DNA, 638 bp, Homo sapiens
  misc_feature: GZ8MTXP01ATGSY.22.86.H09.1.454.CMB.2.raw
  modified_base (226)..(226): a, c, t, g, unknown or other
  modified_base (238)..(238): a, c, t, g, unknown or other
  modified_base (245)..(245): a, c, t, g, unknown or other
  modified_base (284)..(284): a, c, t, g, unknown or other
  modified_base (607)..(607): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcaggtcgtccgggtctcctggacagtcagtcaccatctcctacactggaaccagcagtgattgttggtgttataactntgtctcgtggtnaccaacncgccaccgaggaccaaacgccccagactcatctatttangctgacaaatacggccgccctcgacgggtccctgactcgtcttctcgtcgcctacaagtccctaggaccaaacgcccgtccctaccctcgaaccctatccgtcgtcggggtcctaccgaagggtcctaagaaagtgtaggacggtcttagttaattactttacgtgtcgttcgtcttacgttagtttcggggacgtacgggtccctaccgttaacgtcggttcggggtcggttaccgggacgggtacgggaaccgacggtcggtcgtaccggttaccgtacggacgaccggaccgacggttccgttccgtccccgtcggtccnccttccgttccttaaccccgttcccgtcccg

SEQ ID NO: 386498 - DNA, 620 bp, Homo sapiens
  misc_feature: GZ8MTXP01EI71L.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcacatggagtttgggctgagcttgggttttcctcgttgcttcttttaagaggtgtccagtgtcaggtgcagctggtggagtcgtgggggagcgtggtccagccgtgggagtcctgagactctcctgtgcagcgtctggtatcaccttcagtggctagtggcatgcacgtggcctccgccaggccgtccggggcgaagggggctaggggaggttggggtacgacctaaagttatagtagggtataggaagtaagggaaagttaaacgtaaagacttagttcgggtacggaaaccttccgggtaaggaaacgggtacccgtaattaccgaacctatacctacccgaagaacgaaccaaacctaccaaaacgaaacctacttacgttacgttacctaacctaaatacgaaactacgccgtaggaacgacgggacgaacgggacacgggcttagtgtaacttagttgttagaacgagaagatacgactaagttcgtaaacg

SEQ ID NO: 386499 - DNA, 568 bp, Homo sapiens
  misc_feature: GZ8MTXP01B8H0N.22.86.H09.1.454.CMB.2.raw
  modified_base (358)..(358): a, c, t, g, unknown or other
  modified_base (532)..(532): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaaggggctggagtgggtggcaattatatggtatgatggaaagtaataaagactatgtggactccgtgaagggccgattcaccatctccagacgacaactaccaaagaacacttctacgtttcaccaaatnaacaagcctgagagcgagacacgggcagtgtatactgtgcgagagatcgacatgaactacgggaaatcgttttagagttcgcgtcggggaccgaaagggacacgtcgtccaccggttctcttcacgccctaccgaccgaaacgggtccccagtttcggttcccgtttcccccgngggtccctccccgtcgttcctcccgaaggtaacccg

SEQ ID NO: 386500 - DNA, 697 bp, Homo sapiens
  misc_feature: GZ8MTXP01ELBHJ.22.86.H09.1.454.CMB.2.raw
  modified_base (191)..(191): a, c, t, g, unknown or other
  modified_base (328)..(328): a, c, t, g, unknown or other
  modified_base (339)..(339): a, c, t, g, unknown or other
  modified_base (353)..(353): a, c, t, g, unknown or other
  modified_base (357)..(357): a, c, t, g, unknown or other
  modified_base (391)..(391): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccaggcctgggaggtccctgagactctcctgtgcagcgtctggattcaccttnatggctatgcatgcactgctcgccgagcgtccgggcaaggggctgggagtgggtggactaattatagtgttagtaggaatagggaaagtaaataaagctaagtggtaggacgtccggtaggaacgggccgatccacntaccaccaganaaccaactaccaanaacncccctattaccgtttactacaaatacgaacaacnccgtgacggagacggacgcgacgggtcaggttgttaagttaccgtaggtacggagaggaacgtacgtccgaaacgtaagggtaacgtaaacccgggttaaggggaaacttttcggtttcgtaggttccggtcgggtaacgggggacccgtaaacgggttaccgacggttaccggtaccgtacccgttccgttccttaacccgtacccgttaccccgacccgttaacggaaccccgggtcccttaccggttcccgttcccccgtttccccgtcggccccgtacccgtcgacccgtccgcgaacccgg

SEQ ID NO: 386501 - DNA, 581 bp, Homo sapiens
  misc_feature: GZ8MTXP01B2B9I.22.86.H09.1.454.CMB.2.raw
  modified_base (445)..(445): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccaggccgtgggacggtccctgacgactctcctgtcgcagcgtctggtactcaccttcagtggctagtggcatgcacgtggcctcccgccagggccgtcccggggacgaagggggctgggaggtggggtggacctaagttatagtggtatagatggaaataaataaagctagtgagactcgagaacggcattccacatcaccagacaacaactacaagtaacncgttctttagttaccctaacaaagtcgaaactacgaccgtaggaacggacgggacgaacgggaacgacgggcttaggttagttaacgttgttggcggaagaagtaacgactacgacgtaagttcgggtaaaccggg

SEQ ID NO: 386502 - DNA, 575 bp, Homo sapiens
  misc_feature: GZ8MTXP01CGIKB.22.86.H09.1.454.CMB.2.raw
  modified_base (227)..(227): a, c, t, g, unknown or other
  modified_base (365)..(365): a, c, t, g, unknown or other
  modified_base (394)..(394): a, c, t, g, unknown or other
  modified_base (399)..(399): a, c, t, g, unknown or other
  modified_base (408)..(408): a, c, t, g, unknown or other
  modified_base (410)..(410): a, c, t, g, unknown or other
  modified_base (417)..(417): a, c, t, g, unknown or other
  modified_base (419)..(419): a, c, t, g, unknown or other
  modified_base (556)..(556): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggnaagggggctgggagtggggtggactaattatagtggtatgataggaaataaataaagatagtggtggactccgtaggaaaggccgattcaccatctccagacgacaactacaaagaacactctcgtttacacaaagtnaaacaagcctgagaggcgagactacgggntagtntaattacgngngagagananacgacagtacgtaacggtaaggtaattcggttagcgtcgtacgggtacggacgaaggactacgtcgtctacccgtctcctcgacgccctacaaccggaccgtcccttcgttcccgttccccgtcccgcgcccgaccnccgaccgtaaccgcggccc

SEQ ID NO: 386503 - DNA, 655 bp, Homo sapiens
  misc_feature: GZ8MTXP01B5HDG.22.86.H09.1.454.CMB.2.raw
  modified_base (285)..(285): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagcgtgggtggagtcggtgggggagcgtggtccaggccgtggggacgtccctgacgtctctcctgtcgcagtcgtctggacttccaccttnaggtggctagtggcatcgctacgtggcctccgccgagggccgtccgggagaggggctgggaggtgggtgacctaagttagtagtggtaataggaagtaagggaaacgttaaataaagtacgtagtcgggtacggtaaccgtaccgggtaggaaaccggggtcctaacgttaccaacccgtattacccgacgaagaacgaacctaaacctacgtaaacgaccttactttcgttacgtttaccaaccgtaaagtacgaaacgtacggtaccgtaagggacggaacggcgggaaacggacgaccggtattaggttacgttattacggttgacggcgaggaacgtacgtacgacgtaagttaacggtaaacggg

SEQ ID NO: 386504 - DNA, 617 bp, Homo sapiens
  misc_feature: GZ8MTXP01BQUFI.22.86.H09.1.454.CMB.2.raw
  modified_base (309)..(309): a, c, t, g, unknown or other
  modified_base (341)..(341): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccagccgtgggacgtcctgagtctctcctgtgcagcgtctggatcacttcagtgctatggcatgcacgtggctccgcaggcgtccgggngaagggggctgggagtggggtgcctaagttanagtggtataggaatgggaaagtaaataaaggacttagtggtacgggacctccgtaggaacggggacctattaccactacgtctaccaaggacaacaactaccaaacgaaccgtacttcttacgtttacctaaccctaaaagttcgaaacacggtacccgtaggaacggacgggaccggaagggaaccgaccgggtacttaagggttacgttaagtttacgttgggttacggaacgaaggtaaggacgtccgaacttaacggaaggttaaacccggg

SEQ ID NO: 386505 - DNA, 678 bp, Homo sapiens
  misc_feature: GZ8MTXP01DLG69.22.86.H09.1.454.CMB.2.raw
  modified_base (644)..(644): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgccaggccgtccgggacgaagggggctgggaggtggggtggactaaattatagtggtatgaataggaaagtaaataaagactatggtaggactcgtaggaaacggccgattccaccatctccagacgaacaacctaccaaagtaaccacttcttcgtttaccaaccaaatacgaaacacgtacctggacggacgggacgaggaccgacgggactaggtattagttacgtggtgacggaagaagtacgtacgaacagttaacggaacggtaaacggggtaaaagttcgtttttagacgtttccggtacggtacgggggaacccgaaaggggtactaaaccggtcgggttcctaacccgttcttccttaacgacgttcccctaccgaacccgaacgggcccttacgttcccggttacccctttcccccgnggccccgtcccgtcgcccgtccgaacggaacccg

SEQ ID NO: 386506 - DNA, 632 bp, Homo sapiens
  misc_feature: GZ8MTXP01EPEL6.22.86.H09.1.454.CMB.2.raw
  modified_base (341)..(341): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccggcgaaggggctgggaggtgggtggctaattatagtggtatgataggaaagtaataaagactagtgtggactcgtggaaggccgatcaccatctacagagaacaactaccaagaacnctctcgtttactacaaatgaacaacgcctgagagggacgaggacgacggcagtatattacgtgtgcgaagagactacgacagtacgaacgtaagggtaaacttcggttttagagttccgtacgggtcggggaccgaacgggactaccggttcgggtaccctacccggttcttccttaaccgaccggttcccctacccgttaaacccgaaccggggtcccccttagttccccggggttcccctttcccccgggcggccccgtaccccgtcgacccgtccgaacgggaacccg

SEQ ID NO: 386507 - DNA, 600 bp, Homo sapiens
  misc_feature: GZ8MTXP01AJ9ER.22.86.H09.1.454.CMB.2.raw
  modified_base (554)..(554): a, c, t, g, unknown or other
  modified_base (570)..(570): a, c, t, g, unknown or other
  modified_base (575)..(575): a, c, t, g, unknown or other
  modified_base (583)..(583): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccaggccgtggggacgtccctgacgtactctcctgtgcaggcgtctggtactccaccttcgagtggctagtggcagtcgcacgtcggcctcccgccgaggccgtccggggacgagggggctgggacggtggggagacctaaagtttagtagtgggtatacggaattgggaaaataaacgtaaagacttagtggtacggtacctccggtaggaacggccgtattccaactatcctaccaagacgaaccaaaccgtcaaacgaactcttacgttacgtttaccaaccaaaatcgaaaccgagccgtaggaacgacgggcgaacggtacacggganaggtagttacttaggngacgngagaagancgataagttcgaaacgg

SEQ ID NO: 386508 - DNA, 608 bp, Homo sapiens
  misc_feature: GZ8MTXP01D1FFS.22.86.H09.1.454.CMB.2.raw
  modified_base (256)..(256): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggcaattanagtggtatgatggaaagtaaataaagactatgtggactccgtgaaagggccgattcaccatctccagagacaactcaaagaacatctgttctacaaatgaacaagcctgagaggcgaggacacgggcagtgtattactgtgcgaagagatcgactagtagaaccgtaaggggaaaagtcgtttttaggagttacctcgtacgggggacccaaaggggactaacggtcggtacctacccggtcttccgttcacggcccctacccgaaccgaaaccggggtccccagttcccgggttcccctttccccccggtggcccgttccccgacggttcccttcccgaacgggtaacccg

SEQ ID NO: 386509 - DNA, 612 bp, Homo sapiens
  misc_feature: GZ8MTXP01B2JDJ.22.86.H09.1.454.CMB.2.raw
  modified_base (270)..(270): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccagccgtgggagtccctgagctctcctgtgcagcgtctggatcaccttnagtggctagtggcatcgcacgtcggcctcccgccgagggccgtcccgggggcgaacgggggctagggaggtcggggtggacctaatttatagtggtatagaagtaagggaaagttaaacgaaagtacgttagtggacgggtaccgtccgtaggaacgggtaccgagtttccaccattcctaccagacgacaaacctaccgaaacgaaccgtacttcttacgtttacctaccaaaagtcgaactaacggcccgtaggaacggacgggcggaacggacgacggcgttaggttcgtaattacgttgacgcggaagaacgtagtacggataacgttcgtaaacggg

SEQ ID NO: 386510 - DNA, 512 bp, Homo sapiens
  misc_feature: GZ8MTXP01EURRL.22.86.H09.1.454.CMB.2.raw
  modified_base (328)..(328): a, c, t, g, unknown or other
  modified_base (338)..(338): a, c, t, g, unknown or other
  modified_base (360)..(360): a, c, t, g, unknown or other
  modified_base (364)..(364): a, c, t, g, unknown or other
  modified_base (464)..(464): a, c, t, g, unknown or other
  modified_base (477)..(477): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggatcaccttcagtggctatggcatgcacgtggctccgccaggctccgggcgaagggggctgggagtgggngaccaattanagtgtatagatggaaagtaaanaagntatgtgactcgtgaggcgatcacatctacagagacactacaagaacacttcttacgttccacctaaatgaaacagcctagagaggcgaaggtacacgggnagtgtaattacgngttgcgagtaagactcggactaagttcggaaaccg

SEQ ID NO: 386511 - DNA, 704 bp, Homo sapiens
  misc_feature: GZ8MTXP01BTULA.22.86.H09.1.454.CMB.2.raw
  modified_base (172)..(172): a, c, t, g, unknown or other
  modified_base (270)..(270): a, c, t, g, unknown or other
  modified_base (278)..(278): a, c, t, g, unknown or other
  modified_base (314)..(314): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctggggagtccctgagactctcctgtgcagcgtctggatcaccttnagtgctanggcatgcacgtggcctccggccaggccgtccggggnaagggggcttgggggagtggggtgccaatttagtatgggtataggaagtggaaacgttaaataaagtacgttagttgggtcgggtaacccgttccggtaggaacggggtccgtaatttacccgaacctacttccgtacccgaagaacgaaccaaacccgtaccgaaaacggtaaacctacccgtttactttaccggtttttaccaacccgtaaaacgttcggaaaccctacggtaccccgtaggaacggggaaccggggaccggaaacggggaaaccgaccgggggtaccttaaagggttaggttaacttttaccggttaggggttacggtaaccgggtaaggaaccggtaacgttaccccgggaactaaggtttcgggtaaaacccggg

SEQ ID NO: 386512 - DNA, 681 bp, Homo sapiens
  misc_feature: GZ8MTXP01CKFNS.22.86.H09.1.454.CMB.2.raw
  modified_base (321)..(321): a, c, t, g, unknown or other
  modified_base (336)..(336): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccggcaaggggctgggagtgggtggcaattatagtggtatgataggaaagtaaataaagactagtgtcgactcgtaggaagggccgattcacatctcaganacaactcaaagaacnctctcgtttacacaaatgaacaagctgagagggacgagacgacggcagtagtattacgtgcggtacgaagagtagtacgaacgagttacgaacggttaacgggtaaagttccggtttttagacgtttaccgtaccggttacgggggaacccaaacgggggtacctaaccggttcgggttaccctaacccggtttccgttccttaaccggaccttacccccgttaaccccgaaaccggtaaacccggggtaccccttaccgggtttccccggttccccgtttccccccggtcgggaaccccgtcccccgtttacggccccgttaacccggttaacggtaaccccgg

SEQ ID NO: 386513 - DNA, 569 bp, Homo sapiens
  misc_feature: GZ8MTXP01AQ1FT.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaaggccgattcaccatctccagagacaactcaaagaacactctcgtttacacaaatgaactagcctgagaggcgaggacaggcagtgtatacgtgtgacgagagatcgacatcgacgtaacgggaaatcggttttagaactcgtacgtggggaccaaaggggccacgtcgtcctaccgtctcgttcacgttcctaccgaccgtaaacgggcccttacgttccgggttcccttcccccgtggtcccgtcccgtcgaccctccgaacggaacccg

SEQ ID NO: 386514 - DNA, 684 bp, Homo sapiens
  misc_feature: GZ8MTXP01CEF9J.22.86.H09.1.454.CMB.2.raw
  modified_base (156)..(156): a, c, t, g, unknown or other
  modified_base (172)..(172): a, c, t, g, unknown or other
  modified_base (267)..(267): a, c, t, g, unknown or other
  modified_base (309)..(309): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttccncgttgctcttttaagnggtgtccagtgtcaggtgcagctggtggagtcgtgggggagcgtggtccagccgtgggagtcctgagctctcctgtgcagcgtctggatcacttnagtgctatggcatgcactggcctccgcgagggccgtccgggngaagggggctgggaggtggggtgacctaaagtttatagtgggtatacgaagtaagggaaagttaaaagtaaacggacttaagtagggttacgggaaccgttccgggtaggaaacgggccgtaacgttaccaacctacgtaccgtaccgaacggaaacgaaccaaaccgtaccgaaaacgaacccgtacttaccgtttacgttttacccaaacctaaaagttacgaaaccgaacggtacccgtaagggaacggaacgggcggaaacggggaacgaccgggaccgttaagggttacgttaagtttaaccggttgggttaggtaacccgggaaggaacgtacgttaccgggaactaacggttaacgggtaaaaccggg

SEQ ID NO: 386515 - DNA, 651 bp, Homo sapiens
  misc_feature: GZ8MTXP01CU3WL.22.86.H09.1.454.CMB.2.raw
  modified_base (189)..(189): a, c, t, g, unknown or other
  modified_base (229)..(229): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggctccgccaggctccggganaaggggctgggaggtgggtgactaattatatggtatgataggaaataaataaagactatgtgactcgtgaaggcgatcacatctacagagacaactacaagacactctcgttacacaatacgaacaacgcctgagagggacgaggacgacggcagtagtatacgtgtgacgagagatacgacagtagaacgtaacgggtaaagtcgttttagacttacgtcggtacggggaaccgaaacggggacctaaccggttacgtacccgtacccgttcttcccgttaaccgaaccgttccccgttacccgaacccggtaaaccggggtccccttaaaccggtttccccgggttaccccgttttcccccccggcgggtcccccgtccccgtccggttaccccgttaacccggaaccgggtaaccccgg

SEQ ID NO: 386516 - DNA, 554 bp, Homo sapiens
  misc_feature: GZ8MTXP01DTWKA.22.86.H09.1.454.CMB.2.raw
  modified_base (362)..(362): a, c, t, g, unknown or other
  modified_base (371)..(371): a, c, t, g, unknown or other
  modified_base (385)..(385): a, c, t, g, unknown or other
  modified_base (518)..(518): a, c, t, g, unknown or other
tcagacatacgcgtcacgaccggtgctcgatttagtgctatagacttgggtttgggggggaagaggaagactgacggtcctgccacaggtggttctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctggggacggtccctgagactctcctgtgcagcgtctggattcaccttcagtggctagtggcatgcacgtggctccgcaggcgtcgggcaaggggctgggacgtggggtgctaattntaagtggtntgataggaaataanaagtctatgtgactcggagaacggctatcacatcacagacgacaactaccaagaacactcttgttacctactaaagtcgaaacacgtccgtaggaacggagggaccggaagggaaccgacggggtcaaggttnttaaacgttgtaggtgacgagagtaacgttcgaacg

SEQ ID NO: 386517 - DNA, 600 bp, Homo sapiens
  misc_feature: GZ8MTXP01BIPCZ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggagtccctgagactctcctgtgcagcgtctggatcaccttcagtggctatggcatgcactggcctccgccaggctccgggcaagggggctgggagtggggtgcctaattatagtggtatgaatgggaaagtaaataaaggacttagtaggtggtaacctccggtaggaaggggccgaacttccgacccagtcctaccgagtaacgaccgaaacctaccaaacgaactacttactagtttacctaccgaaattcgaaactacgccctaggacggaagggccgaaggggaaccgacgggaccgaagttaggttaacttacggttcggttggaaccggaggaaggtactacggactaaggttcgtaaaccggg

SEQ ID NO: 386518 - DNA, 565 bp, Homo sapiens
  misc_feature: GZ8MTXP01CYWC5.22.86.H09.1.454.CMB.2.raw
  modified_base (362)..(362): a, c, t, g, unknown or other
  modified_base (417)..(417): a, c, t, g, unknown or other
  modified_base (542)..(542): a, c, t, g, unknown or other
  modified_base (548)..(548): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactcccctgtgcagcgtctggattcaccttcagtggctatggcatgcactggctccgccaggctccgggcaaggggctggagtgggtgcaattatatggtatgataggaagtaaataaagactatgtggactccggtagaaggccgattcaccatcaccagagaccaactccaaagaaccactctgtttcccaccaaatgaaacngaccctagaagagggcgaaggacacggcagtgtattactgtgcgagagatacganagacgaacgtacggaaagtcttttaggaactcgtcgtacggggaccaaggcacgtcggtctaccgtctcttcaacgtcccttaccaccgacggaccctacgttccgttcccttccccgtggcccnccgtcncttaccgaagcgaaccc

SEQ ID NO: 386519 - DNA, 654 bp, Homo sapiens
  misc_feature: GZ8MTXP01BRO0T.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcacttcagtggctatggcatgcactggcctccgccgaggcgtccgggcgaaggggctgggagtggggtgactaattatagtggtatgataggaaagtaaataaagtactagtggtaggactcggtagaacggccgattcaccatcctaccagacgaacaactaccaaagaacctacttcttacgtttactaccaaatcgaaacacgcctggagacgggacgaggacgacggcagttgtatacgtggtgacggaagacgatacgaacaagtacgaacgtaacgggaaatttcggtttagacgttccgtacggtacggggaacccgaaagggactaaccggttcggtacccgtaacccggttcttccggtttccacggttaccccgtacccgaaccggtaaaccgggcccttaccggttccggttccccttccccgtcggcccgttcccgcgttccgtaacccgcggtaacccg

SEQ ID NO: 386520 - DNA, 679 bp, Homo sapiens
  misc_feature: GZ8MTXP01B0U0B.22.86.H09.1.454.CMB.2.raw
  modified_base (353)..(353): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaaggggctgggaggtggggtgactaattatagtggtatgagtaggaaagtaaataaagtactatggtaggaccgtcggtaggaacgggccgtattcaccatcctccagacgaacaactacgaaanaactactctcgtttacctacaaatcgaacagcctgagagggcgaaggacacggcagttgtattacgtgtgacgaagtagactacgaacagtacgaaccgtaaaggggtaaacttcggtttttacgaagttccgtacgggtacgggggaaccccgtaaaggggacctaaccggttcggtaccctaaccggtttccttccgttaaccgaccggttaccccttaccccgaaccgtaaacccggggtcccttacggtttccccgggttacccctttcccccggcggtccccgtccccgttcggaccccttaaccggaaccgggtaacccg

SEQ ID NO: 386521 - DNA, 664 bp, Homo sapiens
  misc_feature: GZ8MTXP01A1TY6.22.86.H09.1.454.CMB.2.raw
  modified_base (259)..(259): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggaggtccctgagctctcctgtgcagcgtntggatcaccttcagtgctatggcatgcacgtggcctcccgcgaggccgtccgggcgaagggggcctgggacggtggggtggtaccctaaagtttagtagtgggtataggaataagggaaataaagtaaagacttagtggtacggacctaccggtaggaacgggtccgtaattccgaacctactccgtaccaagaaccgaactaaacctaccgaaacgaaaccgtacttaccttaacgtttaccctaaccctaaaacttcgaaaaccgtacggaccctagggaacgggacgggaccgggaaacgggtacccgaaacggggtcttaagggttacgttaaagtttaccgttggttacggaacggaaggaacgtacgtacccggaaactaaggttaacgtaaaaccggg

SEQ ID NO: 386522 - DNA, 564 bp, Homo sapiens
  misc_feature: GZ8MTXP01AV1V7.22.86.H09.1.454.CMB.2.raw
  modified_base (502)..(502): a, c, t, g, unknown or other
  modified_base (538)..(538): a, c, t, g, unknown or other
  modified_base (556)..(556): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtaggcaattatagtggtatgataggaagtaaataaagactatgtggactccgtgaagggccattcaccatctaccagagacaactcccaaagaaacacttctcgtttacctaccaaaattcgaaacaagccctggaagagggcgaggacgacggcagtgtattactgtgcgagagatcgacatagaacgtacgggtaaatcgttttgatcgtcggtaggggccaagggactacgtgtccaccgtctctcacgttcccnccaccgaacgggcccacgttccggttccttccccgnggcccgccctggcctcgngggaaccg

SEQ ID NO: 386523 - DNA, 650 bp, Homo sapiens
  misc_feature: GZ8MTXP01DH9DL.22.86.H09.1.454.CMB.2.raw
  modified_base (190)..(190): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttnagtggctatggcatgcactggctccgcaggcgtccgggcgaaggggctgggaggtggggtgactaattatagtggtatgaataggaaagtaaataaagactaatgtggactccggtagaaggccgattcaccatctccagagacaactcaaagaactactctacgtttcacaaatcgaaacaacgctggaagagggacgaggacacgggacagtgtaattacgtgtgagagagatcggacagtagaacgtaagggaaagttcgtttaggaacttccgtcggtacgggggacccgaaaggggaccctaacgttcgggtacctaacccggttctccgttccgaacggcccctacccgaaacccggaaaccggggtccccttaacggttcccggttccccgtttcccccccgcggggtccccgtcccccgttggaccccttaaccccggaacggtaaccccgg

SEQ ID NO: 386524 - DNA, 559 bp, Homo sapiens
  misc_feature: GZ8MTXP01ET5K2.22.86.H09.1.454.CMB.2.raw
  modified_base (484)..(484): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtggcaattatatggtatgatggaaagtaaataaagactatgtggactccgtgaaggccgattcacatctcagacgacaactccaaagaacacttctcgttctacaaatgaaccaagcctgagaggcgaggacacggcagtgtattacgtgtgcgagagatcgacattagaactaacggggaagtcgttttagatcgtcgtggggaccaagggacacgtcggtccaccgtctcttcacnccctaccaccgaacgggcccacgttcccggttacccttcccccgtggcccgcccctcgacctcccgcggaacccg

SEQ ID NO: 386525 - DNA, 659 bp, Homo sapiens
  misc_feature: GZ8MTXP01ET8FF.22.86.H09.1.454.CMB.2.raw
  modified_base (520)..(520): a, c, t, g, unknown or other
  modified_base (621)..(621): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagccgtgggacgtcctgagactctctgtgcagcgtctggtatcaccttcgagtggctagtcggacagtcgcctacgtcggccctcccggaccgacggggccgtccccggggggaacggtaacggggggtccgttaggggaggggtttcgggggtacggtaccctaaaggtttataaggtagggtaagtaaggtaagtaagggtaaagtaaaataaagtactagtgggtaggtaccgtcgggtagaacgggtactacttccacctacgtcaccgaagtaacaacctaactaaccgaaanacctacttagttaccttacctaaaccaagttaacgaaccgaagtcccgtaaggacggacgggcgaacgggaccgacgggcgttaaggttctaagttaccgnggttacgaacgaaggtcagtaccgataagcgtaaacgg

SEQ ID NO: 386526 - DNA, 686 bp, Homo sapiens
  misc_feature: GZ8MTXP01EVJ3C.22.86.H09.1.454.CMB.2.raw
  modified_base (251)..(251): a, c, t, g, unknown or other
  modified_base (323)..(323): a, c, t, g, unknown or other
  modified_base (638)..(638): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctcctgngcagcgtctggtatcaccgttcagtggctagtggcatgcacgtcggcctcccgaccgaggtccgtcccgggngaagggggtccttgggagtgggggtagacctaaagtttagagttggtaataaggaagttaagggtaaacgtaaaataaaaggtacttaagtgggtacgtaaccgtcccggtaggaaaccggggtctacttaccaactactacctacccgaaagaacgtaacccaaaccgttaacccgaaacgtaaaccctacctttaccggtttaaacgtttaccctaaacccgaaaattacggaaaccgtaacgaccgtaggaacggacgggacgggtaacgggaacccacggggcttaaagggtttagtaacgttttaacggnggttacggaagaaggtaacgacgtacgaacgtaaggttaacgaaccgg

SEQ ID NO: 386527 - DNA, 654 bp, Homo sapiens
  misc_feature: GZ8MTXP01BJP7C.22.86.H09.1.454.CMB.2.raw
  modified_base (409)..(409): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggcgtccgggcaagggggctgggagtgggtgactaattatatggtatgataggaaagtaataaagactatgtcggtactccggtgaaacgggccgattcaccatctccagagacaactccaagaactactctcgtttccacaaatgaacaacgcctgacgtagggacgagacgacgggactagtgtattacngtgcgagagactacgactatacggaacgtacgggggtaaattcggttttagaacgttcctcgggttaggggacccgaaacgggtacgtaccgtacggttcgacccggttccttccgtccgtaccgccccgttaccccgaaaccggtaaaccggggtccccttacggttccccgtttaccccggttccccccttcggggccccggttaacccctcggttcccgttaaccccgaacggggtaacccg

SEQ ID NO: 386528 - DNA, 698 bp, Homo sapiens
  misc_feature: GZ8MTXP01EVEBZ.22.86.H09.1.454.CMB.2.raw
  modified_base (654)..(654): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccgaggccgtccgggcgaagggggctggggaggtgggtgactaaattatagtggtatgaagtagggaaagtaaataaagactaatggtaggaaccgtccggtagaacgggtccgaatttccacctatctacccgagaacgaacaaacctccaaagaaacctacttcttacgtttaccaaccaaatcgaaaccaagcctgagggaggacgaggaccgacggctagtgtattacgtgagacgtaagaacgtatacgaacgagtacggaaacgtaacggggtaaagttcgttttggaacttcgtacgggtaggggtacccgaaaggggtaccctaacggttcgggtcctaacccggttcttccgttaaccgacgttaccccgtaccccgaaaccggtaaccgggtccccttacggtttcccggttacccccgtttccccccgngggtcccccgtccccgtcggccccgttccgaacggggaaccccg

SEQ ID NO: 386529 - DNA, 667 bp, Homo sapiens
  misc_feature: GZ8MTXP01BNG0V.22.86.H09.1.454.CMB.2.raw
  modified_base (260)..(260): a, c, t, g, unknown or other
  modified_base (414)..(414): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccgaggcgtccgggacgaaggggctgggagtggggtgcaatttanagtggtatggataggaaataataaagactatgtggactccgtagaacgggccgtattccacctatcctaccaagacgaacaacctacaaagacacttcttacgttacctacaaatcgaactaacgacctgacgaggacgaggacacggctagtntatacgtgtgacgagaagtactacgaacagtacgtaacgtaacgggtaaagttcggttttacgacgttccgtacggtacgggggaaccgtaaagggtaccgtaacgtcggtcccgtaacccgttcgttcccgttaacgaccgttacccgttaccccaaaccggtaaccgggtccccttaacggttccccgttaccccgtttccccccggtcggtcccgtccccgtcgttcccgttcccgaacggtaaccccgg

SEQ ID NO: 386530 - DNA, 686 bp, Homo sapiens
  misc_feature: GZ8MTXP01ASRDL.22.86.H09.1.454.CMB.2.raw
  modified_base (228)..(228): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgcaggctccgggnaaggggctgggagtgggtggactaattatagtggtatgataggaaagtaaataaagactagtggtggactcggtagaaagggccgtatccacatcctccagacgacaactccaaagaacactctcgttcacaaatgaacaagcctgagagggacgacggaccgacggctagtagttattacgtggtcgacgagagtacgtacgaacgtagtacgaaacgttaaacggggtaaacttggttttacggaacgttaccgttcgggtacggggacccgaaaggggtaccctacggttacggtcccgtaacccggttcttacccgttaaccgaaccgggttacccctacccggttaaaccccggaaacgggggtcccccttaacgggttccccgggttcccctttcccccccgggcgggtccctccccgttacgggttcccgtaacccggcgggtaaccccgg

SEQ ID NO: 386531 - DNA, 658 bp, Homo sapiens
  misc_feature: GZ8MTXP01BYG4C.22.86.H09.1.454.CMB.2.raw
  modified_base (356)..(356): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtcggcctccgccgaggccgtccggggacgaagggggctggggagggtggggtaggactaagttatagtggtatggataggaataataaagactagtggtgactcgtaggaaggccgtatccacatctacagacacaactacaagaacnctctacgtttcctacaaagtcgaacacgacctgagacggacgacgacgacggctagtgttatacgtggtgacgtagaagtactacggaacagtcgaaacgggttaaacgggaaacgtttcgttttacggtaacttcggtttaccgggcgggggtaacccgaaaggggtaccctaacggttcggtaccctaccggttctcctttaacgaaccggttccctacccgaaccgtaccgggtcccttacgttcccggttccccttaaccccgcggcccgtccctcgaccctccggaacgtaaccccg

SEQ ID NO: 386532 - DNA, 610 bp, Homo sapiens
  misc_feature: GZ8MTXP01CV4ES.22.86.H09.1.454.CMB.2.raw
  modified_base (332)..(332): a, c, t, g, unknown or other
  modified_base (388)..(388): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcgaaggggctgggaggtgggtggactaattatagtggtatgataggaagtaataaagactatgtggactcgtgaggcattcacatctacagacgaacaactacaanaacactctcgttacacaaatcgaacaacgcctgagaggacgaggacgacggcagtntatactgtgacgagagactacgatagacgaacgtaagggtaaagttcgtttagaacttccgtcggtacgggggaccgaaggggactacggtcgtcctaacccggttcttccgttcaccgttcccgtacccaacccggtaaaccggggtcccaaccggtttcccgggttcccctttcccccgcgggtccccgtcccgttcggcccgttcccgaagggaacccg

SEQ ID NO: 386533 - DNA, 605 bp, Homo sapiens
  misc_feature: GZ8MTXP01B6VH3.22.86.H09.1.454.CMB.2.raw
  modified_base (227)..(227): a, c, t, g, unknown or other
  modified_base (325)..(325): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtggggtggctaattatatggtatgataggaaagtaaataaagactatagtggactccgaggaagggccgattcaccatcacaganacaactaccaaagaacactcttacgtttacaccaaatcgaacaagcctgagaggacgaggacacggcagtgtatacgtgtgacgagagactagacagtcgaacgtaacgggaaagttcgtttagtaacgtcgtacgtaggggaccgtaacgggacacgtcgtaccgtaccgttcctcgttccacgccccttaccgacccgtaaacgggccccttaacgttcccggttccccgtttcccccgcgggtcccgtcccgtcgccctaaccggaacggtaacccg

SEQ ID NO: 386534 - DNA, 693 bp, Homo sapiens
  misc_feature: GZ8MTXP01A8IJB.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcgtccgggcaagggggctgggaggtggggtggacaattagtatggtatgatagggaaagtaaataaagactagtgtggactccggtagaagggccgattcaccatctaccagacgacaactaccaagaacacttctaccgtttcacaaatcaactagcctgagaggcgaaggacacgggtcagtgtaatacgtgtgacgagagtatcgacagtacgaacgtaaccgggaaagttcgtttagacgttccgtacgggttacgggaccggaaacggtacgtaaaccgttcggggtaccctaaccggttcccttcccgtttaaccgaccgttacccccgttacccgaaaccccgggaaaccggggtccccccgttaaaggttcccccgggtttacccccgtttcccccccgggtttacgggccccccgtaccccgttccgggccccgtttaaccccggaaaccgggggttaaccccg

SEQ ID NO: 386535 - DNA, 777 bp, Homo sapiens
  misc_feature: GZ8MTXP01BVS8J.22.86.H09.1.454.CMB.2.raw
  modified_base (734)..(734): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgcgaggcgtccgggacgaaggggctgggaggtgggtggactaattatagtggtatggaagtaggaaataaataaagtactagtggtaggtaccgtccggtaggaaacgggtccgtaactttaccgaaccctactcctaacccgaaggaacgaaacctaaaccgtaccaaaacgtaaactaccgttcctttacgtttaccctaaacctaaaagtacgaaaacccgaaacgtacccgtaagggaaacgggaacggggaccgggaaacgggtaaccgaacggggactaaggttacgttaatttacggtaggtgacgtaaggaagtacgtacgaactaagtcggaaacgtaaacggggtaaattcgttttaggacgttccgtacgggtaggggaacccgaagggtccgtaaccggttcggtacctacccgtttctccgttccgaacgttccccgttaaccccgaaacccggtaaccggggtcccccttacgggtttccccgggttcccccctttcccccgggnggtcccccgtcccgtccggttacctcccggaacgggaaccccg

SEQ ID NO: 386536 - DNA, 646 bp, Homo sapiens
  misc_feature: GZ8MTXP01AMQIW.22.86.H09.1.454.CMB.2.raw
  modified_base (255)..(255): a, c, t, g, unknown or other
  modified_base (341)..(341): a, c, t, g, unknown or other
  modified_base (401)..(401): a, c, t, g, unknown or other
  modified_base (608)..(608): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaagggggctgggagtgggtgcaattanatggtatgataggaaagtaaataaagactatgtggactccgtaggaagggccgattcaccatctccagacgacaactccaagaacnctctcgttacacaaatgaacaagcctgagagggcgaggactacgggcagtgtacttacgngtcggcgagagtagacggacagtacgacgtaaacgggtaaagtccgttttagaacttccgtacggttacgggggaccgaaacgggacgtaccgttaacgggtcccgtaaccccgttcttcccgttaaccgaacggttccccctaccccgaaacccgtaaaccgggggcccccttaacgttccccgggtttacccctttccccccggnggccccgtaccccgtcggcctaacccgaagggaacccg

SEQ ID NO: 386537 - DNA, 565 bp, Homo sapiens
  misc_feature: GZ8MTXP01DMT3M.22.86.H09.1.454.CMB.2.raw
  modified_base (192)..(192): a, c, t, g, unknown or other
  modified_base (270)..(270): a, c, t, g, unknown or other
  modified_base (507)..(507): a, c, t, g, unknown or other
  modified_base (545)..(545): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccagcctgggagtccctgagctctcctgtgcagcgtctggatcaccttnagtggctatggcatgcacgtggcctccgccaggccgtccgggacgaagggggcttagggaggtggggtaggacctaagtttagtagtgggtaattaaggaataagggaaaagtaaataaaagactaagtggtaggtacctcgtagaaggccgattcacatcacagacacaactcaaagactactctagtttcaccaaatcgacaagtcctaggagacggccgaaggtacgccggganaggtagttattaacgttgttaggaacgaagaacgtaanacgactaagttaacggtaag

SEQ ID NO: 386538 - DNA, 604 bp, Homo sapiens
  misc_feature: GZ8MTXP01CHY6E.22.86.H09.1.454.CMB.2.raw
  modified_base (253)..(253): a, c, t, g, unknown or other
  modified_base (274)..(274): a, c, t, g, unknown or other
  modified_base (556)..(556): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagtctctcctgngcagcgtctggactcaccttnagtggctagtggctagtgcacgtggcctccgccgtagggccgtacccgggggacgaaacgggggtctgggggaggttcgggggtaggtaccctaaagttttagagttagggtataaggaagtaagggaaagttaaataaacgtactaagtgggtacggaccgtaccggtagaacgggtccgtattaccaccgtatccgtacagaacacaaacctcaaacgaactacttcttacgtttaccacaaatcgaacagcctaggagacgggagtaacggacacgganagttcgtattcgttgttgcgagaagagtaccgataacgttgtaaccgg

SEQ ID NO: 386539 - DNA, 647 bp, Homo sapiens
  misc_feature: GZ8MTXP01BNT7A.22.86.H09.1.454.CMB.2.raw
  modified_base (405)..(405): a, c, t, g, unknown or other
  modified_base (419)..(419): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggctccgggcgaaggggctgggagtgggtgcaattatatggtatgataggaagtaataaagactatgtgactcgtgaaggccgatacaccatctccagacgacaacgtaccaaagaacactctcgttactacaaatgaacacgacctgagacgggacgacggacgacggcagttgtattactgtgngagagatacgacanacgaactaacgggtaaagtcgttttaggaagttccgtacggttacgggggaccgtaaacggggactaaccggtcgggtaccctaacccgggttcccttccgttaaccgtacggttaccccttccccgaaacccgtaaaccggggcccccttaacgttccccgggttccccgtttcccccccgcgggtcccgtcccccgttcggaccccgttaaccggccgaacccggg

SEQ ID NO: 386540 - DNA, 744 bp, Homo sapiens
  misc_feature: GZ8MTXP01EU6A9.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagcgtggtggagtcgtgggggagcgtggtcagccgtgggacgtcctgagactctcctgtgcagcgtctggtacttcaccttgagtggctagtggcatcgctacgtcggcctcccggccgacgggtccgtacccgggggacggaaacggggggtccgttagggggacggggttgggggtacggtacttaaaaggtttaaagttagttgggttaaagtagggaaagttaaaggggtaaaaagttaaaagtaaaacggtacttagttcgggtacggtaaccgttaccgggtaggaacggggtaccctatttacccgaacctacgtccaacgaagtaacgaaacccaaacgtaacccgaaaagtaaccctaccttaccgttacgttttaacccaacctaaaagtacgaaaccgtacggtacccgtaagggaacggaacggggacggaaaccggaacgaacccgggttagttaaggttacgtttaagtttaccggtgggttccgggaacgttaacggtaagttaacgtaacccgg

SEQ ID NO: 386541 - DNA, 598 bp, Homo sapiens
  misc_feature: GZ8MTXP01DKAIG.22.86.H09.1.454.CMB.2.raw
  modified_base (377)..(377): a, c, t, g, unknown or other
  modified_base (384)..(384): a, c, t, g, unknown or other
  modified_base (565)..(565): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtggctaattatatggtatgataggaagtaaataaagactatgtggactcgtagaaggccgatcacatctcagagacaactcaagaacactctcgttcacaaatcgaacaagctgagagcgagacacggcagtntattacngtgacgagagatacgacagttacgaaacgtaacggggtaaaattcggttttagaattccgtacggtacgggggacccaaaggggtacctaacgtggtaccgtaacccgttcttccttaacacggttacccctacccgaaccgaaacgggccccttaagttcccgggttccctttcccccgnggcccgtccccgtgcccgtcccgaagggaaccc

SEQ ID NO: 386542 - DNA, 617 bp, Homo sapiens
  misc_feature: GZ8MTXP01C4THU.22.86.H09.1.454.CMB.2.raw
  modified_base (569)..(569): a, c, t, g, unknown or other
tcagacatacgcgtcacgaccggtgctcgatttagtgctatagacttgggtttgggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtgggggagcgtggtccagccgtgggagtccctgagtactctcctgtgcagtcgtctggacttcaccttcgaggtggctagtggcagtcgcacgtcggctcccgcgacggccgtccgggacgaagggggtctagggaggttgggtagactaagtttagtagtggtaatgaagtaggtaaaaacgttaataagactagtggtacggacctcggtaggaacggcctattccacctatccgtacaagtacgaaccaactaccaaagaacctacgttccttaggtttacctaaccgaaatcgaaacctacgccgtaggaagacggacggaacggaccgacggtaatagttcgttattcgtggngacgttgagtctacgaagtacgtcggaacggttaacggttaagtttcg

SEQ ID NO: 386543 - DNA, 546 bp, Homo sapiens
  misc_feature: GZ8MTXP01CL4GP.22.86.H09.1.454.CMB.2.raw
  modified_base (407)..(407): a, c, t, g, unknown or other
  modified_base (529)..(529): a, c, t, g, unknown or other
  modified_base (533)..(533): a, c, t, g, unknown or other
  modified_base (538)..(538): a, c, t, g, unknown or other
  modified_base (545)..(545): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaaataaagactatgtggactccgtgaaagggccgattcaccatctccagagacaactccaaagaaacactctcgtttactacaaaatcgaaacaaagccctggagagggcgagggacacgggcagtgtattacngtgcgagagatcgacatgaactaacggggaaagtcttttagattctcgtgggggaccaaaggggacactggtcaccgtctcttcacgcctccacaaacgggccacgttcggttcttccccgngccncctcnctcgcgng

SEQ ID NO: 386544 - DNA, 600 bp, Homo sapiens
  misc_feature: GZ8MTXP01EV46C.22.86.H09.1.454.CMB.2.raw
  modified_base (435)..(435): a, c, t, g, unknown or other
  modified_base (565)..(565): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgccaggctccgggcaaggggctgggagtgggtggacaattatatggtatgatggaaagtaaataaagactaatggtaggactccggtaggaaacgggccgattccaccatcctccagagaaccaactccaaagaaccactcttcgtttacctaccaaatgaaacacgacctggagagggcgaggacacggctagtgtattacgtgtgacgagagatcganatagaacgtaaggggaaattcgttttagacttcgtcggtggggaccaaggggacacgtcggtccaccgtcttcttcacgccctaccacccgaacgggccccttacgttcccgggttccccttcccccggnggtccccgtcccctggccctccgaacgggaacccg

SEQ ID NO: 386545 - DNA, 604 bp, Homo sapiens
  misc_feature: GZ8MTXP01ATXHE.22.86.H09.1.454.CMB.2.raw
  modified_base (193)..(193): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggtttttcctcgttgcttcttttaagaggtgtccagtgtcaggtncagctggtggagtcgtgggggagcgtggtccagccgtgggagtccctgagctctcctgtgcagcgtctggatcaccttcagtggctatggcatgcacgtcggcctccgccgaggccgtccgggggacgtaagggggcttaggggaggttggggtacgacctaaagtttagtagtgggtactaggaagttaagggaaaactaaataaaggcttagtggtagggaccgtaccgtagaaacgggccgtattccactacgtctacgagacgacaactaccaaagactacttctacgttacctaaccgaaatcgaaacgtacgaccgtaggaggacggcgaaggaaccgacggacaggttagttaacgttacgttgttaccgaagacgcttacggacttagtcgaacgttaacggg

SEQ ID NO: 386546 - DNA, 602 bp, Homo sapiens
  misc_feature: GZ8MTXP01BP46J.22.86.H09.1.454.CMB.2.raw
  modified_base (336)..(336): a, c, t, g, unknown or other
  modified_base (370)..(370): a, c, t, g, unknown or other
  modified_base (564)..(564): a, c, t, g, unknown or other
  modified_base (580)..(580): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcttgggttttcctcgttgctcttttaagaggtgtccagtgtcaggtgcagctggtggagtcgtgggggagcgtggtccagccgtgggagtccctgagctctcctgtgcagcgtctggattcaccttcaggtggctagtggcatcgcacgtggcctcccgcaggcctcggganaacgggggctggggagtgggtcgactaagttaanagtgggtatgggaactaggggaaaattaaacgtaaagtacttagtggtaggacgtccggtaggaacggggcctagttacaacctatacctaccgaagacgaactaaacctaccgaaacgtaacctacttcgttacgtttacctaaccaaaattcgaacacgcctaaggacggagggcgaaggaccgacgggacngttacggtaattacgngtaggacgagaacgttgtaacg

SEQ ID NO: 386547 - DNA, 609 bp, Homo sapiens
  misc_feature: GZ8MTXP01AIMRU.22.86.H09.1.454.CMB.2.raw
  modified_base (173)..(173): a, c, t, g, unknown or other
  modified_base (260)..(260): a, c, t, g, unknown or other
  modified_base (271)..(271): a, c, t, g, unknown or other
  modified_base (312)..(312): a, c, t, g, unknown or other
  modified_base (342)..(342): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtggtccagccgtggggacgtccctgagctctcctgtgcagcgtntggatcacttnagtgctatggcatgcacgtggcctccgcgaggcgtccgggnaagggggctgggagtgggtagactaagttntagtggtatggaatggaaagtaaactaaagacttagtggtacgggtaacctccggtaggaacgggtccattccacccgtatcctaccgagaacgaaccaaactaccaaacgaacctacttcttacgtttaccaacctaaatcgaaacacgtacctaggaacggacggccggaaggaaccgaccgggtacttaaaggtttggtaactttacggttggttacggaaccggtaagaagtacgtacgaacctaagttaacggtaaaccggg

SEQ ID NO: 386548 - DNA, 572 bp, Homo sapiens
  misc_feature: GZ8MTXP01BV4B9.22.86.H09.1.454.CMB.2.raw
  modified_base (372)..(372): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggagtccctgagactctcctgtgcagcgtctggattcacctttcagtggctatggcatgcactggctccgccaggctccgggcaaggggctgggagtggggtgactaattatagtggtatgataggaaataaataaagactatgtggactcgtgaaggccattcacatctccagagacaactccaaagacactctcgttacacaaatgaacaacgcctggacgacgggngaacggacgtacgggactagtagtattacgtgtcgacgtagagagttcgaacagtacgaacgtaacgggaaagttcgttttagacttcgtacggtaggggaccgaagggactacgtcgtccaccgtctctccacgcctcccacgaacggcccttagttcccggttcctccccgtggccaccctggccctcgaacgaaccg

SEQ ID NO: 386549 - DNA, 713 bp, Homo sapiens
  misc_feature: GZ8MTXP01DJ3I9.22.86.H09.1.454.CMB.2.raw
  modified_base (227)..(227): a, c, t, g, unknown or other
  modified_base (312)..(312): a, c, t, g, unknown or other
  modified_base (328)..(328): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggcgtccggnagggctggagtgggtgacaattatatggtatgataggaagtaaataagactaatggtgactcgtagaagggccgattcaccatcncagacacaactacaanaacactctacgtttaccacaaagtcaacgacgacctgagaggacgagacgacgggactagtgtattagtgtcgacgtagagacttacgaacgtagtacgaacgttaaacggggaaacgtttcggttttaacggtacgtttcccgttaccgggttacgggggaaccccgaaagggggttaacccctaaacggtttccggggttaccctaaacccgggttttccgtccccttttaaccgaccggttacccccttacccccggaaaccccgtaaccgggggtaccccccttaacggtttcccccgggtttaccccccgttttccccccggtccggggtccccgtcccccgttccggaccccgtttcccggaacccggggtaaccccgg

SEQ ID NO: 386550 - DNA, 537 bp, Homo sapiens
  misc_feature: GZ8MTXP01EX5X8.22.86.H09.1.454.CMB.2.raw
  modified_base (360)..(360): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggagcgtggtccagccgtggggagtccctgagactctcctgtgcagcgtctggattcaccttcagtggctatggcatgcatggctcccgcaggctccgggcaagggggctgggagtgggtggcattaanagtggtatgatggaaataataaagactatgtaggtactccgtggaacgggcgattcaccatctccaagacgaacaactccaaagaacactctcttctaccaaatgaacacgcctgaggaggcggaggaccgacggacgaggttgtaagttacgtgtggacgttagaaggaataaccg

SEQ ID NO: 386551 - DNA, 586 bp, Homo sapiens
  misc_feature: GZ8MTXP01EKIMF.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtgctaattatatggtatgataggaaagtaaataaagactatggtggactccgtgaagggccgattcaccatctccagacgaacaactacaaagaacactcttcgttctacaaatgaacagcctgagaggcgagacaggcagtgtattactgtgcgaagagagtacgacagtacgaacgtaacgggtaaagtcttttaggattcgttacgcgggggaccaagggacacgtggtccaccgttctcttcacgttcctaccgaccgaacgggccccttacggttcccgggttcccctttccccgcgggccccgtccccgtacgttcccgttcccgaacgggtcccg

SEQ ID NO: 386552 - DNA, 655 bp, Homo sapiens
  misc_feature: GZ8MTXP01D9Y5I.22.86.H09.1.454.CMB.2.raw
  modified_base (573)..(573): a, c, t, g, unknown or other
  modified_base (624)..(624): a, c, t, g, unknown or other
tcagacatacgcgtcacgaccggtgctcgatttagtgctatagacttgggtttgggctgagctgggttttcctcgttgctctttttaagaggtgtccagtgtcaggtgcagctggtggagtcgtgggggaggcgtggtccagcctgggaggtccctgagactctcctgtgcagcgtctggattcaccttcagtggctatggcatgcactggcctccgcaggcgtccggagaaggggctgggagtgggtgactaattatagtggtatgagtaggaaataaataaagtactagtggtaggactccggtaggaaacggccgtattcaccatctaccaagacgaacaaccgtacaaagtaactacgtcttacgttaccaacaaatcgaaacaacgcctggagacgggacgaaggacgacggactagttagttattacgtggagacgaagaagtactacggaactaagtacggtaaaccgttaaggggtaaactttccggtttttaaggacgtttaccgtacgggtacggggaacccgaaaggggtcctaaacgtcggtacctaccgtctcgttaacncggttacctccgaacgaccggtcccttacgttcccggttccccttccccgnggccctcccgtgcctccgttaacggaacccg

SEQ ID NO: 386553 - DNA, 572 bp, Homo sapiens
  misc_feature: GZ8MTXP01EHCHZ.22.86.H09.1.454.CMB.2.raw
  modified_base (296)..(296): a, c, t, g, unknown or other
  modified_base (329)..(329): a, c, t, g, unknown or other
  modified_base (403)..(403): a, c, t, g, unknown or other
  modified_base (523)..(523): a, c, t, g, unknown or other
  modified_base (548)..(548): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtggggggagtcgtggtccaggccgtgggggacgtccctgacgtaccttctccgtgtgcagtcgtctggtatccacttcagtggctatggnatgcacgtggcctccgcgacgggccgtccgggngagggggcgtggaggtggggtgactaattgtagtcggtataaggaataagggtaaataaacgtaaagcttaggnggtacggtaccgtcggagggaacgggtccattaccactacgtcctaacgagtacaaccactacaacgaactcttcgtattaccacaatgaacagtccaggagaggcaaaggcttacgggnttagtgtaacttgttgcgaaggaangctagacttaaggaagtaaccggg

SEQ ID NO: 386554 - DNA, 591 bp, Homo sapiens
  misc_feature: GZ8MTXP01DNN87.22.86.H09.1.454.CMB.2.raw
  modified_base (382)..(382): a, c, t, g, unknown or other
  modified_base (386)..(386): a, c, t, g, unknown or other
  modified_base (395)..(395): a, c, t, g, unknown or other
  modified_base (402)..(402): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtggcaattatatggtatgaatggaagtaataaagactaatgtggactcgtgaaaggccgattcaccatctccagagacaactccaaagaacactctgtttctaccaaatgaacaagcctgagaggcgaaggcaacggnagtntatatgtgngagaganacgacatagaacgtaacgggtaacgtacgtttagtatcgtacgtacggggtaccgaacggacgtacgtcggtcgtaaaccgtccttcttcacgaccctacccaacccgtaaaccgggtacccgttacgttcccggttccccttcccccgttccggtcccgtcccgtcgttacccgtcccgaacggaacg

SEQ ID NO: 386555 - DNA, 673 bp, Homo sapiens
  misc_feature: GZ8MTXP01BQMBM.22.86.H09.1.454.CMB.2.raw
  modified_base (418)..(418): a, c, t, g, unknown or other
  modified_base (431)..(431): a, c, t, g, unknown or other
  modified_base (453)..(453): a, c, t, g, unknown or other
  modified_base (632)..(632): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtcctgagactctcctgtgcagcgtctggattcaccttcagtggctatggcatgcactggcctccgcgaggctccgggacaaggggctgggagtggggtgctaattatagtggtatgataggaaataaacaaagtactagtggtcggactccggtaggaaacgggccgaattccacctatcctaccaagacgaactaacgtacaaagaactacgttcttacgtttccaacaaatcgaaacagccgtgagaacgggcgaaggaccacggnagtgttattacgngtagacgagaacgtgtaccganacgtagaacgttaaacgggaaacgttcggtttagacgttacgttaccgggtcgggggaacctaaacggggtaccgtaaccgttcgggtacctacccggttctccgtttaaccgaacggttcccctaacccgaaccgtaaccgggtaccccttacgttcccgggttccctttcccccggnggtcccgaccccgtcgacccgttaacccgaagggtaacccg

SEQ ID NO: 386556 - DNA, 660 bp, Homo sapiens
  misc_feature: GZ8MTXP01AERUH.22.86.H09.1.454.CMB.2.raw
  modified_base (255)..(255): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtggggacgtccctgagtctctcctgngcagcgtctggactcaccttcagtggctagtggcatgccacgtggcctccgccgagggccgtcccgggagaagggggtctagggaggtggggtacgacctaaagtttagtagtaggtagtaagaagtaagggaaattaaacgtaaagtacgtagtgggtacgtacgtccgtaggaacggccgtattaccactatccaccaaggaacaacaaactaccgaaacgaactacttacgtttacttaccaaccgtaaagtcgaaaccgtacggtacccgtaagggaacggacgggaccggaaacgggaaccgaacgggtaccgttaaaggtttgttaaacgtttaccgttgggagaaccgggaagaagggtacttacccggaagtaacgttaacgggttaaaacccgggg

SEQ ID NO: 386557 - DNA, 681 bp, Homo sapiens
  misc_feature: GZ8MTXP01CSRDC.22.86.H09.1.454.CMB.2.raw
  modified_base (244)..(244): a, c, t, g, unknown or other
  modified_base (271)..(271): a, c, t, g, unknown or other
  modified_base (281)..(281): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgatggttggtgttaataactatgtctcctggtaccaanagccaccaggaccaaacgccccagacncatctattangctgtacaagtacgccggccctcgacggggtccctagactcgtctttcgcgtcggcctacgtagtctaccggaccaaacgcccggtccctcccgtaacgaccctgtcctcggtcgggcctccggaggtctagaagtagtggacggtcttacgttaatttacgttactcggtacttcgccttcgttacgtttccggacggtacggggtcccgttacccgttacggttacgggtttcgggggtccgggtttaccggggacggggtaaccgggtaccctaacggtccgttaccggtccccggttacgttacgggtacccgaccgaccccgtagggttccccgttcccgttccccccgtggtccctccgttccctcccgttaccccctaaccgttccgtaaccg

SEQ ID NO: 386558 - DNA, 653 bp, Homo sapiens
  misc_feature: GZ8MTXP01EW74T.22.86.H09.1.454.CMB.2.raw
  modified_base (340)..(340): a, c, t, g, unknown or other
  modified_base (357)..(357): a, c, t, g, unknown or other
  modified_base (408)..(408): a, c, t, g, unknown or other
  modified_base (413)..(413): a, c, t, g, unknown or other
  modified_base (423)..(423): a, c, t, g, unknown or other
  modified_base (615)..(615): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctcccgccgaggccgtccgggcaagggggctgggagtggggtggactaaatttatagtggtatgagtaggaaagtaaataaagactatggtaggactccggtaggaacgggcgtattcaccatctacaganaacaactaccaagaacncttctcgtttactacaaatcgaacaacgaccgtgagaggcgaggacacggntagtntatcgtgcgngagagactacgactagtagaacgtaacggggtaaattcggttttagacgtcggtacggtacgggggaaccctaaggggtacctaacggttcggtaacccgtaccgtttcttccgtaacccgtaaccgttccccgttaacccgacccggaaaccggttccccgacgtttccccgggttacccctttccccggngggtcccctacccgtcgccgttaacccgaacggtcccg

SEQ ID NO: 386559 - DNA, 600 bp, Homo sapiens
  misc_feature: GZ8MTXP01DQ7EI.22.86.H09.1.454.CMB.2.raw
  modified_base (273)..(273): a, c, t, g, unknown or other
  modified_base (312)..(312): a, c, t, g, unknown or other
  modified_base (336)..(336): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtggggacgtccctgagactctcctgtgcagcgtctggatcaccttnagtggctatggcatgcactggcctccgcaggctccgggnaggggctgggagtgggtgcattanatggtatgatggaaataaataaagctatggtggactcggagaaggccgtattccactatcctacagacgaaccaacgtaccaaacgaactacgttcttacgtttaccaactaaatcgaaaccgacgtcccgtagggaacggacgggacggaaagggccgaaacgggtaccgttaacggttagggtttaactttaaccggttggttacggaaccgggaaagtaacggtactacccggaaataacggttaaccgttaaaaccgggg

SEQ ID NO: 386560 - DNA, 713 bp, Homo sapiens
  misc_feature: GZ8MTXP01D55AN.22.86.H09.1.454.CMB.2.raw
  modified_base (262)..(262): a, c, t, g, unknown or other
  modified_base (267)..(267): a, c, t, g, unknown or other
  modified_base (278)..(278): a, c, t, g, unknown or other
  modified_base (285)..(285): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagtcttgggtttttcctcgttgtcttcttttaagaggtgtccagtgtcaggtgcagcgtggtggagtcgtgggggagcgtggtccagccgtgggacgtccctgagtacctctcctgtgcngcgtntgatcacttcngtgctanggcatgcacgtcggcctcccggccgacgggccgtacccgggggacgaagggggtcgtgggaggtggggtcgtaaccggttaaatttagtaggtaggttaagtagaaagttaaggggtaaaattaaagtaaaaggtacttaggttcgggtacgggttaccgttcggtaagggtaaacgggtacccgtaattacccaaccgttactcccgtaaccgaaacgaacgaaaccctaaacgtaacccgaaaagtaacccgttactttcctttacgttttaaccaaaccctaaaaagtccgaaaacgtaacggtccgtaaggaacggaccgggaggaaccgggaacgaacccggtagttaagtacggttaattaccggttggttaacggaacggtaagaacgtagtacccggaataaccggttaaggaaaccggg

SEQ ID NO: 386561 - DNA, 662 bp, Homo sapiens
  misc_feature: GZ8MTXP01A7FGC.22.86.H09.1.454.CMB.2.raw
  modified_base (333)..(333): a, c, t, g, unknown or other
  modified_base (394)..(394): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtccgcagcgtctggattcaccttcagtggctatggcatgcactggcctccgccaggctccgggcaaggggctgggagtgggtgactaattatagtggtatggataggaaataataaagactatgtgactcgtgaaggccatcacatctacagacacaactacaanacactctcttactacaaatgaacagcctgagaggcgagacacggctagtgttattacgtgngagagaacgatacgatagacgtaacgtaacggggtaaattcggttttagacgttccgttacgggtacgggggaacccaaagggggtaacctacgggttccggtccctaacccggtttcccttaccgttccaaccggttccccctaaccccggaaaccccggtaaaccggggcccccttaacgggttcccccgggttcccctttaaccccccggtccggggaacccctccccgggttacccgttacccgtaacccggaaccggtaaccg

SEQ ID NO: 386562 - DNA, 615 bp, Homo sapiens
  misc_feature: GZ8MTXP01ARFS1.22.86.H09.1.454.CMB.2.raw
  modified_base (521)..(521): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcgtccgggcgaaggggctgggaggtggggtggacaattatagtggtatggataggaagtaaataaagactatggtggactccgtaggaaggccgattcacatctaccagagaaccaactacccaaagaacacttcttacgtttacctaccaaatacgaacaacgcctggagagggcgacggacgacgggcagtagttacttactgtgacgagaagatacgacagtagacgtaacgggaaagtcgtttagatcgtcgtacggggaccgaacggtacacgtcggtctacccgtcttcctaaccncgttccctaccgttacccgaacgggccccttacgttcccggttccccgttcccccgccgggccctccccgcgttcccgtccggaacggaacccg

SEQ ID NO: 386563 - DNA, 676 bp, Homo sapiens
  misc_feature: GZ8MTXP01E07UD.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgccaggctccgggcaaggggctgggagtggggtgcaaattatatggtatgatgaagtatacgactctagtcgtacgtacgtacggtacggacggtacggtactaccgtacctactacctacgacgaacgaaccgtaaccaaaccaaacgaaactctccctttacgttactaactaacacgtaaacgacgtcgacggacggagacggacgtacggacgacgtagtaacgttcgttacgtgtacgacgggaattacgggacctaacgcgacttacgggacttacgacgggtactttacgggtaacggttcttaccggggccttaccggggacctaccggttaaccggaccgtacctccggtcctaaccgcccttcgtacccaccgccccgtccccaacgggttccccggttcctcccccggtgttcccccgttccggaccgccgtcccgttaacccgtcccgg

SEQ ID NO: 386564 - DNA, 722 bp, Homo sapiens
  misc_feature: GZ8MTXP01AQ9EC.22.86.H09.1.454.CMB.2.raw
  modified_base (691)..(691): a, c, t, g, unknown or other
  modified_base (700)..(700): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggcctccgccgaggccgtccgggacgaaggggctgggaggtgggtggactaaattatagtggtatggaagtaggaaagtaaataaagactagtggtaggactccggtaggaacgggccactttaccaacctataccgtaccaagaacgaacctaaacctaccaaacgaacctaccttacgtttaccgtttacctaaacctaaaagtaccgaaaccgtaacggacccgtaaggggaaacgggacggggaacccgggaacggggaacccggaacggggtaaacgttagggtttacgttaacgttttaaccggtggtacgaccggaagtaacgacgtacgaactaagtacgaacgtaaggggtaaacttcggtttagacgtccgtcgggtacggggaccgaagggcctacggtcgtaaccgtccttctcctcgacgttcccgtaccgaccggaacggtcccttcggttcccgttccccgtccccngggtccccnccgtcgccgtcgcgggtaaccc

SEQ ID NO: 386565 - DNA, 720 bp, Homo sapiens
  misc_feature: GZ8MTXP01BP8X6.22.86.H09.1.454.CMB.2.raw
  modified_base (347)..(347): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggacgtccctgacgactctcctgtgcagcgtctggattcacctttcaggtggctagtggcatcgcacgtggcctcccgccgacgggccgtcccggggngaagggggctggggaggtggggtggactaagtttaagtagtgggtatggaagttagggtaaagtaaataaagtacttagtggtacgggaccgttccgggtaggaaacgggggtccctaatttcccgaacctagttcccgtaccgaaaggtaaccgaaccgtaaacctacccgaaaaggtaacccttaccgttaccgtttacggttttaccctaaaccccgtaaaagttacggaaaacccgtacggtccccgtaagggaaacggacgggggtacccggaaagggggaccccgaacgggggttcccttaagggtttaccggttaattttaaccggtgggtacgggtaccggaagggtaacgttcgtaaccccggg

SEQ ID NO: 386566 - DNA, 655 bp, Homo sapiens
  misc_feature: GZ8MTXP01CCRL8.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtggggtggactaattatagtggtatgataggaaagtaataaagactagtgtggactcgtgaaggcgattcaccatctccagacgaacaactaccaaagaacacttcttacgtttactaccgaaatcgaacaagcctggagagggacgaggacgacggcagttagttattaacgtggtagacggagagaagtcgaactagtacgaacggttaaacggggaaactttcggtttttagacttacgttacggacggggaaccgaaacggggtacctacggttccggtacccgtacccgttccttccgttaaccgaaccgttcccgtaaccccaaccggaaaccgggtccccttacgttcccgggttcccctttcccccggcgggtccctccccgtcgacccgtccgaacgggaacccg

SEQ ID NO: 386567 - DNA, 640 bp, Homo sapiens
  misc_feature: GZ8MTXP01AQ5PR.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcgaaggggctgggaggtggggtgactaattatagtggtatgaataggaaagtaaataagactatggtaggactccgtaggaagggccgattcacctatcctacagaagaacaacctacaaacgaactactcttcgtttacacaaatacgaactaacgacctggaaggaacgggacggaaagggaccgaacgggctaagttggttaacttacgtggtagacggtaagaagtagtaccgaacgtagtacgtaaacggtaacgggtaaagttcgttttaggacgttccgtacggtacggggaccgaagggactacgtcgtcctaccgttctcctaacgacgcccgtacccgacgtaaccggcccttacgttcccgttccctccccgcgcccgtcccgcgaccgtccgaacggaaccg

SEQ ID NO: 386568 - DNA, 592 bp, Homo sapiens
  misc_feature: GZ8MTXP01CLNKB.22.86.H09.1.454.CMB.2.raw
  modified_base (213)..(213): a, c, t, g, unknown or other
  modified_base (523)..(523): a, c, t, g, unknown or other
  modified_base (527)..(527): a, c, t, g, unknown or other
  modified_base (539)..(539): a, c, t, g, unknown or other
  modified_base (556)..(556): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtncagctggtggagtcgtgggggagcgtggtccagccgtgggaggtccctgacgactctcctgtgcagcgtctggacttccacttcagtggctagtggcatgactacgtcggcctcccggacgacgggtcccgtccggggacgaagggggcctggggaggtggggtgactaagttatagtggtataggtaagtagggaaacgtaaagtaaacgacttagtgtaggactcggtaggaacgggcctattcaaccagtccacaagacaacaactacgaaacacctacgtcttacgtttacaaccaaatcgaaccngccnggaacgacgggngaacggtacacgggttnttagttagttaatagtggcgacggagaagctaacgg

SEQ ID NO: 386569 - DNA, 683 bp, Homo sapiens
  misc_feature: GZ8MTXP01ACFRT.22.86.H09.1.454.CMB.2.raw
  modified_base (190)..(190): a, c, t, g, unknown or other
  modified_base (257)..(257): a, c, t, g, unknown or other
  modified_base (268)..(268): a, c, t, g, unknown or other
  modified_base (643)..(643): a, c, t, g, unknown or other
  modified_base (661)..(661): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtgggacgtcctgagctctctgtgcagcgtcnggatcaccttnagtgctagtggcatcgcacgtggcctccgccagggtccgtcccggggacgaaggggggtctagggggagttgggggtacgacctaaagtttagtagtacggtaatgggtaaattggggtaaaacgttaaaagtaaaacggtacttaaagtgggttaacgggaacccgttaccgggtacgggaaacggggtcccgtaaatttcccgaaccctacttaccgtaccaacggaacgaaaccaaacctaccctaaaacgaaaccgtacttaccgttacgtttaccctaaaccctaaaagttacggaaaccgtacggacccgttagggaacggacggggaccggaagggaaccgttacggggacttaggtagtacttacgngttaggcgtagaacgtancggaatcgttaaggtaaaccgg

SEQ ID NO: 386570 - DNA, 632 bp, Homo sapiens
  misc_feature: GZ8MTXP01BLRYV.22.86.H09.1.454.CMB.2.raw
  modified_base (240)..(240): a, c, t, g, unknown or other
  modified_base (264)..(264): a, c, t, g, unknown or other
  modified_base (367)..(367): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaangcacccaggcaaacgccccagacncatcattatgctgtacaataacgccgccctcgacgggggtcccctgactcgtcttctcgtggcctccgaagtctcggacaaacgccggccctccctagacccntctcgtcgggctccgaggtctagaagtatggaggctagtactttagtactgctgctctagtttcgacggtacggtcctccgtaacgtcggttggggtcggttccggggacgggaacgggaacccgtaacggtccgtaccggtaacccggttccgttaaacgggtccgaccggtaccccggaacggttcccgttcccgttcccccccggttcggttccctaaccttcccggttccccgttcccccgaaccccgttcctaaccccgg

SEQ ID NO: 386571 - DNA, 695 bp, Homo sapiens
  misc_feature: GZ8MTXP01BV978.22.86.H09.1.454.CMB.2.raw
  modified_base (449)..(449): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtggctaattatatggtatgataggaaagtaaataaagactatggtaggacgtccgtaggaaacgggccgatttccacctatcctacccgagaacgaacaactaccaaagaaacctacttcttacgtttacctaacctaaagtacgaaacaaacgcccgtggaaaggacgggacgaacgggaccacgggactaggttagtattacgnggtcgacgaagacgatcgaacagtacgaacgtaacgggaaattcgtttagacgttccgtacgggtacggggaccgaaaggggtcctaacggttcgtcccgtaacccgttcttcccgttcgaacccttccccgtaacccgaaaccgggtaaacccgggtccccttaaggttcccccgggtttcccccgttccccccggtgggtcccccgtccccggttcggcccgttaacccggaacgggtaacccg

SEQ ID NO: 386572 - DNA, 734 bp, Homo sapiens
  misc_feature: GZ8MTXP01B06EW.22.86.H09.1.454.CMB.2.raw
  modified_base (512)..(512): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtcctgagactctcctgtgcagcgtctggattcaccttcagtggctagtggcatgcacgtggcctccgccgacgggccgtccggggacgaagggggcgtgggaggtggggtgactaattatagtggtatagagtaggaaagtaaataaagactagtgtacggaccgtccggtaggaaacgggtccgtaacttccgaaccctactcctaccgaaggaaaccgaaccgtaaacctaccgaaaacgtaaaccctacttcctttaccgtttaccctaaacctaaaagttcgaaaacctaacggaccctaagggaagggacggggaccgggaacgggaccgaacggcgtagttacgttaatacgtggnggacgtaaggaacgtactcgaaactagaccggtaaggaacgtttctttagacgtttacgccgggtacgggggacccaaaaggggtcctacgtaccggtctaaccccgttcttccgtccaacggcccttacccgtaaacggacccggtcccctaggtttcccggttccccttccccggtccggcccgtccccttggacccttcccggtaagccggtaaccccg

SEQ ID NO: 386573 - DNA, 646 bp, Homo sapiens
  misc_feature: GZ8MTXP01DW6FE.22.86.H09.1.454.CMB.2.raw
  modified_base (253)..(253): a, c, t, g, unknown or other
tcagacatacgcgtcacgaccggtgctcgatttagtgctatagactttgggtttgggctgagctgggtttttcctcgttgctctttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaaggggctgggagtggtgcaattnatggtatgatggaagtaataaagactatgtggactccgtgaaagggccgattcaccatctccagacgacaactccaagacactctcgtttcacaaatgaacaacgcctgagaggacgagacgacgggcagtgtattacgtgtgcgagagactcgacagtagaacgttacgggaaagttcggtttagtaacgttcgttcggtacgggggtaccccgaaagggttaccgaacgttcggttaccgtaacccgttcgttccttaacgcgttaccccgtaccccgttaacccggaaaccggggtcccccttaacggttccccgggtttccccgttcccccccggtcgggtccccgtccccgtccggttcccgtcccccggttaaagggtaacccccgg

SEQ ID NO: 386574 - DNA, 611 bp, Homo sapiens
  misc_feature: GZ8MTXP01BUPDX.22.86.H09.1.454.CMB.2.raw
  modified_base (433)..(433): a, c, t, g, unknown or other
  modified_base (496)..(496): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaaggggctgggagtgggtgctaaattatatggtatgataggaaagtaaataaagactatggtggactccggtagaacggcgtattcgacctatctccagaacgacaacctcaaagaacacgtacttgtttaccactaaatgaactaacgaccctggagacgggagaacgacacggactagtgtattactggtgacgagagatacganagagaagtaacgggtaaatcgtttgatcgtcggtaggggaccgaaggggacacggtcgtaccnccgttactcctaacgcgttaccctaccgaccgtaaaccgggccccttacgttcccgggttcccttcccccggtcggtccccgtcccgtaccggttcccttccggaacggaacccg

SEQ ID NO: 386575 - DNA, 529 bp, Homo sapiens
  misc_feature: GZ8MTXP01EJSZX.22.86.H09.1.454.CMB.2.raw
  modified_base (361)..(361): a, c, t, g, unknown or other
  modified_base (382)..(382): a, c, t, g, unknown or other
  modified_base (391)..(391): a, c, t, g, unknown or other
  modified_base (515)..(515): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgccaggctccgggcaaagggggctgggagtgggtggcaattaanatgggtatgatggaaagtaanaaagactangtggactccgtgaaggccgattcaccatctcagagacaactaccaaagaacaactctgttttctacccaaaatgaacacgcctgagagggcggaggacgaacggcgagttgtaattataagtgngagaagaagtaacg

SEQ ID NO: 386576 - DNA, 709 bp, Homo sapiens
  misc_feature: GZ8MTXP01EVY8V.22.86.H09.1.454.CMB.2.raw
  modified_base (259)..(259): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggagtcctgagctctcctgtgcagcgtntggatccacttcgagtgctagtggcagtgctacgtcggcctccgccgacgggtccgtcccgggggacgaacgggggcgttggggaggttggggtagtacctaagtttagtagtaggtataagaagtaagggaaacgttaaaagtaaagtacgttagttagggtacggtaccgttaccggtaggaaacgggtccgtaacgttaccacctaacgtcctacgaaacgtaacgaacctaacctaaccgaaagtaacctacgttacttacgtttaccctaaaccgtaaaacgtacgtaaaaccgtacggtaccgtaagggaacgggaaacgggacccggaaacgggggaaccgaccggggtaccgttaagggtttaagtttaacggtttacccggttgggttacggaacggtaaggaacgtaagttacgaacgtaagttaacggtaaaaccgggg

SEQ ID NO: 386577 - DNA, 625 bp, Homo sapiens
  misc_feature: GZ8MTXP01CWSY3.22.86.H09.1.454.CMB.2.raw
  modified_base (356)..(356): a, c, t, g, unknown or other
  modified_base (377)..(377): a, c, t, g, unknown or other
  modified_base (423)..(423): a, c, t, g, unknown or other
  modified_base (587)..(587): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttctttttaagaggtgtccagtgtcaggtgcagcgtgggtggagtcgtgggggaggcgtggtccaggccgtggggacggtccctgacgactctcctggtcgcaggcgtctggtacttccaccttcgagtggctagtggcatcgcacgtggcctcccgcgaggccgtccgggngagggggctgggaggtggggngactaaagttatagtggtataggaagtagggaaaataagtaaacgntaagtagtacggtacgtcggtaggaacgggctacttacaacctattccgacaaggaaccaaccgtaaacctaccgaaaacgaacctaccttacgttacgtttaccaaaccaaacgttacggaacacggtccgaaggaaggacgggacgacggaacgacggacgnggttagtaatacgtgtagcggttagaacgttgtaaccg

SEQ ID NO: 386578 - DNA, 767 bp, Homo sapiens
  misc_feature: GZ8MTXP01BGVLE.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggcgtccgggacgaagggggctgggaggtcggggtggactaaagttatagtggtatgagtaggaaagtaaataaaagtactagtggtacggactccggtaggaaacgggccgtattacaccatctaccgagacgaacaacctaccaaagaaactactcttcgtttacctaacaaatacgaaacacgaccgtggaacggacggacgaacggaccgacgggactaggttattaagttacgtggacgacggaaagaacgtacgtaccggaactagtacggtaaaccgtaaagggggttaaaactttcgttttaacggaacgtttcccgttacgggtagggggaaaccccgtaaaggggtaccgtaaaccggtttcggggtcccctaaacccggtttccttaccggttaaccaccgggttaccccctaacccggaaaccccggggaaacccgggtccccttaaaccgggtttcccccgggttacccccgtttcccccccgggttgggcccccgttacccgttccggacccgttaaccggaacgggtaaccccg

SEQ ID NO: 386579 - DNA, 636 bp, Homo sapiens
  misc_feature: GZ8MTXP01DXF7E.22.86.H09.1.454.CMB.2.raw
  modified_base (424)..(424): a, c, t, g, unknown or other
  modified_base (598)..(598): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctggggaggtccctgagactctcctgtgcagcgtctggattcaccttcagtggctatggcatgcactggctccgccaggctccgggcaaggggctgggaggtgggtggactaattatatggtatgaataggaaagtaaataaagactagtggtaggactcggtaggaaggccgtatcacatctaccagagaacaactacaaagacactctcgttacacaaatcgaacaacgctgagaggcgaggacacggctagttgtaattacgtggacgacgaaggaanactacgactagtacgaacgttaaacggggaaattcggttttagacttaccgtgggtacggggaaccaaaggggtacctaacggttcggtacctaaccgttctccttaacgaacccgttccccgtacccaaccggaaacgggtcccccaggttccccgggttccccttcccccgngggtcccctccccctggaccccttcccgaaggggcccc

SEQ ID NO: 386580 - DNA, 679 bp, Homo sapiens
  misc_feature: GZ8MTXP01B6255.22.86.H09.1.454.CMB.2.raw
  modified_base (473)..(473): a, c, t, g, unknown or other
  modified_base (656)..(656): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagccgtgggaggtccctgagactctcctgtgcagcgtctggattccaccttcagtggctatggcatgcacgtggcctccgccgaggccgtccgggcgaaggggctgggagtggggtgactaattatagtggtatgataggaaagtaaataaagactagtggtacggacgtccggtaggaaacgggccgtaattccaacctatcctaccgaagaacgaaccaaacctaccaaacgtaacctacttcgttacgtttaccaacaaaagtacgaaactaacgcccgtggaacggaacggggacgaacggaccgacgggtctaaggttgttaattacgnggtacgacggaagaacgtactaccgaatagtacggaacgttaaacggggaatttcgtttaggacttccggtacgggtacggggaccctaaaggggcctacgtcggtaccctaccgttctcctcgccgttcccctaccgaaccgaacggcccttacggttcccggttcccttccccgtggcccncccgtcgcctccgaacgaacccg

SEQ ID NO: 386581 - DNA, 697 bp, Homo sapiens
  misc_feature: GZ8MTXP01CBO74.22.86.H09.1.454.CMB.2.raw
  modified_base (469)..(469): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgcacgtggcctccgccgaggccgtccgggcgaagggggctgggaggtgggtggactaaattagtagtggtataggagtaggaaagtaaataaagtactagtggtggtaccgtccggtaggaaacgggccgtaacttcacctactcctaccgaagaacgaacaaccgtaccaaagtaactacttcgttacgtttacctaacaaagtacgaaacaacgtacctggaaggacgggacggaacggacgacgggctagtagtagttacgngtggacgagaagacgtacgaacagtagtaacgtaacgggtaagttacggtttacgtacgttcgtacggtacggggaaccgtaacggtaccgtacgtacggtacccgtaccggttctccgttaaccgtaccggttccctaacccgaaacccggaaaccggtcccgttaaccgttcccggttccccgttccccggtcggcccgtcccgtacgccgtccgaacggtaaccg

SEQ ID NO: 386582 - DNA, 615 bp, Homo sapiens
  misc_feature: GZ8MTXP01CPAIJ.22.86.H09.1.454.CMB.2.raw
  modified_base (190)..(190): a, c, t, g, unknown or other
  modified_base (228)..(228): a, c, t, g, unknown or other
  modified_base (398)..(398): a, c, t, g, unknown or other
  modified_base (411)..(411): a, c, t, g, unknown or other
  modified_base (428)..(428): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttnagtggctatggcatgcactggctccgcaggctccgggnaaggggctgggagtgggtggactaattatagtggtatgataggaaagtaaataaagactatgtggactcgtagaagggccgattcacatctacagagaacaactacaaagaactactctacgtttacacaaatacgaaactaacgcctgaggacggacgaaggacacggnagtgtattacggngtgagagagactacganagtagaacgtaacggtaattcggtttagacgtcgtacgggacgggaaccgtaacggactacggtcgtaccctaccgttcctcgttcacccgttccctaacccgaaaccggtaaccggtccccttacggttccccggttcccctccccggtcggcccgtcccgtcgaccgtaacccgaaggtaacccg

SEQ ID NO: 386583 - DNA, 580 bp, Homo sapiens
  misc_feature: GZ8MTXP01EAKYG.22.86.H09.1.454.CMB.2.raw
  modified_base (227)..(227): a, c, t, g, unknown or other
  modified_base (337)..(337): a, c, t, g, unknown or other
  modified_base (415)..(415): a, c, t, g, unknown or other
  modified_base (503)..(503): a, c, t, g, unknown or other
  modified_base (550)..(550): a, c, t, g, unknown or other
  modified_base (562)..(562): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgcaggctcgggnaaggggctgggagtgggtgactaattatatggtatgataggaaataataagactatggtggactccgtaggaacgggccattcacatctccagacgacaactcaaagacnctctcgttacacaaatcgaacaacgcctgagaggacgagacacggctagtatattacgtgtagacgagagatacgganagtacgaacggtaacggggtaaattcgtttagacttacgtcggtaggggaccaagggtcacgttcggtcctaccgttctctccgaacncccgtacccacgtaaccgggcccttacgttcccggttccttccccgnggtcccgtcccncgcctccgaaggaacccg

SEQ ID NO: 386584 - DNA, 666 bp, Homo sapiens
  misc_feature: GZ8MTXP01DW1HP.22.86.H09.1.454.CMB.2.raw
tcagacatacgcgtcacgaccggtgctcgatttagtgctatagacttgggtttgggctgagctgggtttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggctccgggcgaaggggctgggagtggggtgacaattatatggtatgataggaaagtaaataaagactatggtggactccggtgaaagggccgattcaccatctaccagacgaacaactcaaagaacactcttgtttccacaaaatgaaacaagcctggagagggacgaacgggacacgggctagtagttaattactggtgacgaaggagtacgtacgacaagtaggaaacgtaaacggggtaaaagttccggtttttaggtaacttaccgttacggtacgggggaaccccgaaaggggactaaacggtcggttacccgtaccggttacctcctttaaccgaccgacccttaccccgaaaccgaaaccggggtccccttaacggttccccggttccccgtttcccccgtcggcccgtcccgtcggccttcccgaacgggtaacccg

SEQ ID NO: 386585 - DNA, 672 bp, Homo sapiens
  misc_feature: GZ8MTXP01CEM05.22.86.H09.1.454.CMB.2.raw
  modified_base (279)..(279): a, c, t, g, unknown or other
  modified_base (310)..(310): a, c, t, g, unknown or other
  modified_base (323)..(323): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacggtccctgacgactctcctgtgcagcgtctggtattcaccttnagtggctatggcatgcacgtggcctccgcgnggccgtaccgggngaacgggggtctgggacggttggggtgactaattgtaagtggtaatgagtaggtaaaaaacgttaaataaggactaagtcggtacggtaaccgttacccgggtagggaaaccggggtaccctattaccgaaccctacgtcctaccgaagtaacgaactaaccaccgaaactaacctacttaccgtttacgtttaacctaaaccctaaagtacgtaaaccgacggtaccgtagggaacgacggggaccgtaagggaaccgacggtaacaagggttagttaacgttaccgttggtgacgagttacgaactcgaacgtagtacggttaacgtaacggggttaatttaaccgg

SEQ ID NO: 386586 - DNA, 744 bp, Homo sapiens
  misc_feature: GZ8MTXP01DEER7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtggcctccgccgaggccgtccgggcgaaggggctggggaggtggggtggactaaagttagtagtggtatggaagtaggaaagtaaataaagactaagtggtaggaccgtccggtaggaacgggcctaattaccaacctatacctaccgaaggaacaaaccaaaccgtaccaaacgaactacttacgttactttaccaactaaaagtacgaaaccaacgaccgtaaggaaacggaacgggacggaacgggaaccgaccgggataaggttagttaagttaacgttgggacgaagtaaggaactacgtaccgaacgtaagttacggaaacgttaacgggtaaacgttctttttaggaacgttccgtacgggtacggggaacccgaaaggggtacctaacgttcggtacctacccgttcttaccgttccacccgttacccttaacccgaacccggtaaaccgggtcccttaccggttccccggtttccccttccccggaccgtccccgtcccttacgcccgtaaccggaacgaaccccg

SEQ ID NO: 386587 - DNA, 727 bp, Homo sapiens
  misc_feature: GZ8MTXP01B7G3G.22.86.H09.1.454.CMB.2.raw
  modified_base (174)..(174): a, c, t, g, unknown or other
  modified_base (274)..(274): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagcgtggtggagtcgtgggggagcgtggtccagccgtgggacgtccctgagtctctcctgtgcagcgtctggatcaccttnagtgctatggcatgccacgtggctccgccgaggccgtcgggcaagggggctgggagtggggtgacctaagttatagtggtatagaagtaagggaaagttaaataaacggtacttaagtcggggtacggtaacccgttcccgggtaaggaaaccggggtacccgtaagtttacccaacccgaactttacccgacccgaaacggaaccgaaaccctaaaccgttaccccaaaaggtaaaccccgtaacctttaccggtttaacgtttaaccccgtaaccctaaaagttaccggaaaccgtaaccgggtaccccgtaagggaaccgggaaaggggaccggtaaacggggaaacccgacgggggtaccttaagggttacgttaagtttaccggttggttaccggtaacggaagtaacgttaagtacccgggaactaaggttaacgggtaaaaccggg

SEQ ID NO: 386588 - DNA, 582 bp, Homo sapiens
  misc_feature: GZ8MTXP01AUFAY.22.86.H09.1.454.CMB.2.raw
  modified_base (343)..(343): a, c, t, g, unknown or other
  modified_base (551)..(551): a, c, t, g, unknown or other
  modified_base (573)..(573): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggcaattatatggtatgatggaataataagactatgtggactcgtagaaggccgattcacatctccagagacaactcaagaacactctcgtttacncaaatcgaacaagcctgaggacggcgagggacacggcagtgtatacgtggtgacgagagagtcgacagtagaacgtaacgggtaaagtcgttttaggactcgtacggtacggggaccgaaagggctaaccgtcggtacccgtaccgttctcttccgacgcccgtacccaccgaacgggtcccttacgttcccggttcccttcccccgnggtcccgccctggcccttccgnggtaacccg

SEQ ID NO: 386589 - DNA, 688 bp, Homo sapiens
  misc_feature: GZ8MTXP01ASJWN.22.86.H09.1.454.CMB.2.raw
  modified_base (199)..(199): a, c, t, g, unknown or other
  modified_base (241)..(241): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcaccatctcctacactggaaccngcagtgatgttggtgttaataactatgtctctaggtaccaangccaccaggacaaacgccccagactcatctattatgctgtacaagtaacgccggccctggacgggtccctgacgtccgtctttctcgtcggtcctacgtaacgtccgtacggacctaacgcccggtacccctcccgtaacgtaccctaacgtccgtccggtcgggtcccttaccggacgggtcgttaacgaacgtacgttaggacggtacgttacgttaatttacttacgtcgtccgttgtccttacgtacgtttcgacgggtaacggtccgtaccttacggtacggtttcggggttcggttacgggaccggggtaacggtacccgtaacgtccgtcggtaaccgtccggttacggtaccaccggacccgtaacgggttccgttacccgccccgttcgtaccctaaccgttccgtcccgttaccccgtaacccttcccgtaacccgg

SEQ ID NO: 386590 - DNA, 595 bp, Homo sapiens
  misc_feature: GZ8MTXP01EP62Q.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcacatggagtttgggctgagcttgggttttcctcgttgctctttttaagaggtgtccagtgtcaggtgcagctggtggagtcgtgggggagcgtggtccagcctgggagtccctgagctctcctgtgcagcgtctggactccacttcagtgctatggcatgcacgtgcctccgcgaggccgtcccgggcgaaggggctgggagtgggtgacctaagttatacgtggattaagataagggaaagtaaactaaagcttaagtggtacggtaacgtccgtaggaacgggtccattccaactatccacgaaggacaaacctaacaccgaaataacctacttcctttacgtttaccaacctaaagtacgaacaacgtccgtagaagggacggaccgaagggaccttacggggcttaaagttggttaacttacggttgacggaagaagaaggtacacggataaggttaacgtaaacgg

SEQ ID NO: 386591 - DNA, 633 bp, Homo sapiens
  misc_feature: GZ8MTXP01A9SOP.22.86.H09.1.454.CMB.2.raw
  modified_base (420)..(420): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggagtggggtgctaattagtatggtatgaagtaggaaagtaataaacgtactatggtaggactccggtaggaacgggccgattaccgacctatctaccaagacgaaccaaactccaaagaacacttcttcgttacacaaaatcgaacaagcctggagaggacgagacgacggcagtgtattacgngtcgacgagagactacgactagtacggaacgtaaacggggtaaattcggtttagaacgttccgtacggtacggggaccaagggacctacgtcggtacctaccggtcttctaaccgtacgccctacccgacgtaaaccgggcccttaacgttccccggttccccgtttccccggcggtccccgtccccgtcgttcccgtcccgcggtaaccccg

SEQ ID NO: 386592 - DNA, 636 bp, Homo sapiens
  misc_feature: GZ8MTXP01ED3IS.22.86.H09.1.454.CMB.2.raw
  modified_base (225)..(225): a, c, t, g, unknown or other
  modified_base (240)..(240): a, c, t, g, unknown or other
  modified_base (262)..(262): a, c, t, g, unknown or other
  modified_base (273)..(273): a, c, t, g, unknown or other
  modified_base (363)..(363): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgatgttggtgttataactntgtctctgtaccaangcaccagcaaacgccccagacncatctatttangctgtacaatacgcggccctgacggggtccctgactcgctttctctggacctccaagtctcggaccacgaccgccctcccaacgaccctntccgtcgtcgggcctaccgaggtctagaagatggagtctagtatttatacgtgctgctctagtttcgcgtacgggtccgtaccgttactacggtttcggggtcgtttcgggaccggggtaacggggtaacccaaaggtccgttcggaacccggttccgttacggggtacccttaacggaccccgtaacgggttcccgttccgttcccccccgttaacgggttccctaaccgttcccgtacccggttccccctaacccccgtttcgtaaccccg

SEQ ID NO: 386593 - DNA, 617 bp, Homo sapiens
  misc_feature: GZ8MTXP01ADT3V.22.86.H09.1.454.CMB.2.raw
  modified_base (155)..(155): a, c, t, g, unknown or other
  modified_base (170)..(170): a, c, t, g, unknown or other
  modified_base (174)..(174): a, c, t, g, unknown or other
tcagacatacgcgtcacgaccggtgctcgatttagtgctatagacttgagctctgggagaggagcccagcactagaagtcggcggtgttccattcgctgatcagcactgaacacagaggactcaccatggagtttgggctgagctgggttttccncgttgctctttaagnggtntccagtgtcaggtgcagctgggtggagtcgtggggggagcgtggtccaggcctggggacgtccctgagctctcctgtgcagcgtctggattcacttcagtggctatggcatcgcacgtggcctccgccgaggccgtccggggagaagggggtctggggaggtggggtcggactaagtttagtagtgggtaaatggaagtagggaaaagtaaataaagactagtgggtacggtacgtccggtaggaagggcccgtaattccacctatcctaccaagacgaacctaacgtaccaaaggaacctacttctacgtttaccaacctaaagtacgaaacgacgccgtagacggaacggcggaacgggaaccgaccggttacgtaaggttggttacttaacgttcggttaaggacggtaagacgtagttaccggaacttaagttaacggg

SEQ ID NO: 386594 - DNA, 669 bp, Homo sapiens
  misc_feature: GZ8MTXP01B0R79.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtgctaattatagtggtatgatggaaagtaataaagactatggtgactcggtagaagggccgattcaccatctaccagacgacaactccaagacacttctcgtttacaccaaatcgaacaacgccgtggaacgagggacgacggacgacgggctagtcgttattacgtgtgacgaggagactacgacagtacgaacgtaaccggggtaaagttccggttttagacgttaccgtcgggtacggggacccgaaaggggacctaacggttcggtacctacccggttcgttccttaaccgcgttaccccgttacccgaaacccggaaaccgggtccccttacggttccccgggttccccccgttttccccccggcggggtcccccgttccccggtcggttaccccgttaacccggaacggggtaaccccgg

SEQ ID NO: 386595 - DNA, 684 bp, Homo sapiens
  misc_feature: GZ8MTXP01CP77S.22.86.H09.1.454.CMB.2.raw
  modified_base (187)..(187): a, c, t, g, unknown or other
  modified_base (229)..(229): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttnagtggctatggcatgcactggcctccgcgaggccgtccgggnaagggggctgggaggtgggtggactaaattatagtggtatggataggaaataaataaagactagtggtaggacctccggtaggaacgggcctattccactatcctacgagaacgaacaacctacaaacgaactactcttcgtttacctaactaaatacgaaaccaacgacctaagggaacgggaacggggacgaaagggaccgacgggtacaaggttagttacttacgtggtagacgaggagtatcgaacgtagtacgaacgtaacgggtaaagttcgtttaacgagttcgtacggtacggggaaccgtaaacggggacctacgttcgggtaccctacccggttcttcgtaaccgtacgacccgtacccgaacccggtaaaccgggtcccaccggttccccgttcccgttcccccggcggtcccgacccgtcgcccgtaacgaacgggtaacccg

SEQ ID NO: 386596 - DNA, 527 bp, Homo sapiens
  misc_feature: GZ8MTXP01BT3L6.22.86.H09.1.454.CMB.2.raw
  modified_base (345)..(345): a, c, t, g, unknown or other
  modified_base (494)..(494): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctccgcaggctcgggcaggggctggaggtgggngcaattaatatggtatgagtaggaaagtaataaagactatggtggactcgtgaacgggccgattcacatctccaagagacgaactaccaaagacctactcttgttactaccaaatcgaacacgcaagagaggcgttaggacgacggcgngttagtaattactggtgcgttagcgaataacgg

SEQ ID NO: 386597 - DNA, 650 bp, Homo sapiens
  misc_feature: GZ8MTXP01A9481.22.86.H09.1.454.CMB.2.raw
  modified_base (467)..(467): a, c, t, g, unknown or other
  modified_base (575)..(575): a, c, t, g, unknown or other
  modified_base (616)..(616): a, c, t, g, unknown or other
  modified_base (624)..(624): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtggcctccgccgaggccgtccgggcgaaggggctgggaggtgggtgactaattatatggtatgataggaaagtaaataaagtactagttggtaggactaccggtaggaaacggggcctatttccgacctactcctaccgagacgaacaaacctaccaaagaactactcttacgttaccaccaaatgaaacaacgcccgtaaggagacgggagaacggacgacgggacagttgttaattacgtggtgcggaagaacgtntaacgacgatacggaacgtaaacgggtaacttacgtttaggaacgttcgtacgggtaggggaacccgtaaaggggccttaaggtcgtaccgaccgttctctaacgacnccctaccgaccgaacgcttacgttccggttacccttccccngggccccnccgtacgcccgtaaccgcgggaaccc

SEQ ID NO: 386598 - DNA, 606 bp, Homo sapiens
  misc_feature: GZ8MTXP01AT213.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggacgtccctgagactctcctgtgcagcgtctggattcaccttcagtgctagtggcatgcacgtggcctccgccaggcgtccgggacgaaggggctgggacggtgggtcggactaagtttaatagtggtatgagtaggtaaagtaataaagtactagtgtaggactcgaggacgggtaccgagttcacctagtcctacgaagtacgaaccaaaccttaccgaaacgaacctcttacttacgtttacctaacctaaacgtacgtaaacgacgtacccgaaggaacggacgggacggacggaaaccgagggacccgttagttacgtaattacgtgtggacggagaacgttaagtaacgg

SEQ ID NO: 386599 - DNA, 630 bp, Homo sapiens
  misc_feature: GZ8MTXP01ACVL3.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtggggagtccctgacgactctcctgtgcagcgtcgtggtatcaccttcagtgctatggcatgcacgtggctcccgcgacgggcgtcccgggggacgaagggggtctaggggacggtggggtacggacctaaagtttagtagtggtaatagggaattaagggaaagtaaataaaaggtacttagtgggtcggaccgttccggtaggaacgggccgtattaccaccgtactcctaccaagacgaacaactaccaagaacctactcgttacttacctaaccaaagtcgaaacgtacgcccgtaggacggaggccggaaggaacgttaccggggacttaggttattaagtttaccgttggttgaacggagtaacgtcgttacggactaagttaagttaaaaccggg

SEQ ID NO: 386600 - DNA, 610 bp, Homo sapiens
  misc_feature: GZ8MTXP01BLS4J.22.86.H09.1.454.CMB.2.raw
  modified_base (325)..(325): a, c, t, g, unknown or other
  modified_base (362)..(362): a, c, t, g, unknown or other
  modified_base (526)..(526): a, c, t, g, unknown or other
  modified_base (565)..(565): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcagctggtggagtcgtgggggagcgtggtccagccgtggggacgtccctgacgtctctcctgtgcaggcgtctggatccacttcagtgctagtggcatgcacgtggcctccgccgagggccgtcccgggggngaagggggctagggaggtgggggtcgacctaagttanagtggtactagaagtgggaaaacttaaataaaggactagttgggtacggtacctccggtaggaaacgggcccgtattaccacgtatcctaccaagacgaacaaactacaaagaacctacttacgttgttaccaaccaaagtcgaactacgcgtaagaggacggnggaacggacgttacggacgttaggttacgtaagtttcgnggttcgaacggagtaagacgtcgaactaagttaacgggtaaaccg

SEQ ID NO: 386601 - DNA, 637 bp, Homo sapiens
  misc_feature: GZ8MTXP01ARPN5.22.86.H09.1.454.CMB.2.raw
  modified_base (296)..(296): a, c, t, g, unknown or other
  modified_base (398)..(398): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcctccggggcgaagggggctgggaggtggggtggactaattatatggtatgatagggaaagtaaataaagactangtggactccgtgaaggccgattcacatctccagagacaactaccaagaacactctcgtttactacgaaatcgaacacgcctgagaggcgaggacaggcagtntagtactgtgcgagagactacgacagtacgaacgtaacggggaaagttcggttttagacgttcgtcggttacgggggaccgaaaggggtcctaacgttcgggtaccctacccggttccttccggttaacacgttacccctacccgaacccggaaaccgggtaccccttacggttccccggttcccgttccccccggttggccccgtcccctcggacccgttaaccgaacgggaaccccg

SEQ ID NO: 386602 - DNA, 734 bp, Homo sapiens
  misc_feature: GZ8MTXP01DPVE1.22.86.H09.1.454.CMB.2.raw
  modified_base (480)..(480): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgcaggccgtccgggcgaaggggctgggagtgggtggactaattatagtggtatgagtaggaaagtaaataaaagtactaagtggtacgggtacctaccggtaggaaacggggcccgtaatttaccaacccctaatcctacccgaagaacgaaccaaacctaccaaaacgtaaacctacttctttacgtttaccctaaaccaaatacgaaacaacgcctaaggaggacgggacgaaggaccgacggactagttgtaattacgtggngacgaagaagactacgaacgtagtacggtaaccggtaaacgggggtaaatttccggtttttaagacgtttccggttacgggtacgggggaaccctaagggggacctaacggttcgggtacctacccgttctccgttaaccgccgttcccctaacccgaaacccggtaaacgggtccccttaaggtttccccgggttcccctttccccggtcggccccggtcccctcggttccctaacccggaacggtaaccccg

SEQ ID NO: 386603 - DNA, 611 bp, Homo sapiens
  misc_feature: GZ8MTXP01EB6SW.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcacttcgagtggctagtggctatgctacgtggcctcccgcgaggccgtccggggagaagggggtctgggaggtgggggtgaccgtaaatttatatgggtatagaagttaagggaaagtaaattaaagggatagttagggtcgaacgttacccggtaggaaacgggtcccgtattaccactaactccgtccaagacaacaaacctacaaacgtaaactccttactttacttactaaccctaaagtcgaaaccgaagacctagaaggcgggaccggaaaggtacgacgggacttagtggtttaaacagttggagaacgaggaacgtacgtacgactaacgttaacgtaacg

SEQ ID NO: 386604 - DNA, 685 bp, Homo sapiens
  misc_feature: GZ8MTXP01D7EQ8.22.86.H09.1.454.CMB.2.raw
  modified_base (614)..(614): a, c, t, g, unknown or other
  modified_base (658)..(658): a, c, t, g, unknown or other
  modified_base (664)..(664): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactgggcctcccgccgacggccgtccggggacgaagggggcttggggagggttgggggtggactaaagtttatagttgggtatggaagtaggaaagtaaataaaagactagtggtcggtacgtccggtaggaaacgggccgtatttaccaacctaactcctacccgaaggaaccgtaaaccaaacctacccaaaagaacctacttaccttacgtttacctaacctaaagtacgaaaccgaacgccgtaaggaggacgggacgaacggaccgacggactagttagttattacggtgtaggacgaagacgtaatacgaacgtagttacgaacgttaaacgggtaaacttcgtttagactttcgtacggtaggggaaccgtaagggactacggtcgtcaccgttctctaacncgccctaccgaacgaccggtccacgttcccgttcccttccccgnggcccnccgtcgccctaacgaacgccg

SEQ ID NO: 386605 - DNA, 664 bp, Homo sapiens
  misc_feature: GZ8MTXP01EGSZY.22.86.H09.1.454.CMB.2.raw
  modified_base (225)..(225): a, c, t, g, unknown or other
  modified_base (248)..(248): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcagctccggnagggctggagtgggtgcaattanatggtatgatggaaataataaagactatgtgactcgtagaaggcattcacatctaccagacgaacaactacaagaacactcttcgttcacaaatgaacaagcctggagacgggcgaggacacgggctaagtgtaattacgtgtcgagaagacgatacggaacaagtacgtaacgtaaacgggggtaaattggtttttacgaagttcgtacggtagggggacccgaaacggggtacgtaacgttcggggttacctaacccggtttccgttccttaaccgacggttacccccttaaccccggttaaaccgaaacccgggggtccccttaacggtttccccgggttaccccttttcccccccggtcgggcccccgttccccgttccggccccgttaaccccggaaacggggtaaccccg

SEQ ID NO: 386606 - DNA, 610 bp, Homo sapiens
  misc_feature: GZ8MTXP01D0W1O.22.86.H09.1.454.CMB.2.raw
  modified_base (412)..(412): a, c, t, g, unknown or other
  modified_base (425)..(425): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggcctccgccgaggcgtccgggcgaaggggctgggaggtgggtggactaattagtagtggtatgataggaaagtaaataaagactagtggtggactccggtaggaaacggccgattcacctatctaccaagacgaacaacgtaccaaagaacacttctacgttaccacaaatcgaacaagcctggagagggacgagacacggntagtgtattacgngtgacgagagactacgaactagtacgaacgtaacgggtaaagttcgtttagacgttcgtcggtacgggaccgaaggactaacgtcgtcctaccgttctccttcaccgttccctacccgaaccgaacgggccccttacgttcccgttccctccccgtgccctccgtcgccgtccgaagggtaaccc

SEQ ID NO: 386607 - DNA, 710 bp, Homo sapiens
  misc_feature: GZ8MTXP01BOZHJ.22.86.H09.1.454.CMB.2.raw
  modified_base (676)..(676): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactcggcctccgccgaggccgtccggggacgaaggggctgggaggtggggtgactaattatagtggtatgaagtaggaaataaagtaaagactatggtaggacctccggtaggaacggccgtattccactatctaccagacgaactaaccgtaccaaagaactacttcttacgtttaccaacaaatcgaaaccacgtacccgtggaaaggaccgggacggaaacgggaaccgacggggataaggtttgttaacttacgtgggtagacgaaggtaagtacgtaccgaatacggtaacgtaaaccgtaaagggggtaaactttcgggttttacgacgttaccgtcgggtaaccggggaaccgtaaacggggtacctaaccggttcgtacccgtaccggtttccctcgtaaccgaaccgccctaccccggaaacgaaccgggtcccttacggttcccgttacccccttccccgnggccccgtcccgtcgccgtaaccgaaggaacccg

SEQ ID NO: 386608 - DNA, 598 bp, Homo sapiens
  misc_feature: GZ8MTXP01C9DSW.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctctttttaagaggtgtccagtgtcaggtgcagctggtggagtcgtgggggagcgtggtccagccgtgggacgtccctgacgactctcctgtgcagcgtctggacttcaccttcgagtggctatggcatgctacgtcggcctcccgcagggccgtccgggacgagggggctgggaggtgggtgactaattaatagtggtataggtagtagggaaagttaaataaagtactagttggtaggtacgtccggtaggaacgggccgtacttacgacctattcaccgaagacgaacgtaaacctaccgaaacgactaaccttcttacgttacctaaccaaatacgaacacgcctaaggagacgggacggaggaaccgcggacgagttagttaattacgtgtggacgagtaagaacgtaacg

SEQ ID NO: 386609 - DNA, 618 bp, Homo sapiens
  misc_feature: GZ8MTXP01BR6H6.22.86.H09.1.454.CMB.2.raw
  modified_base (358)..(358): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggccgtccgggcgaaggggctgggaggtggggtggctaaattatagtggtatggataggaaagtaaataaagactagtggtaggactccggtaggaagggccgattcaccatctccagacgttacaactaccaaagaacnctctcgttaccacaaatcgaacagcctgagagggacgaggacacgggcagtgttatacgtgtgcgagagatacgacagtacgaacgtaacgggtaaagttcggtttagacgttcgtacggtacggggaccgaagggacctacgtcggtccgtaccgttccttccttccgacgcccctaccgaccgaaccgggtccccttacgttcccggttccccttcccccgtcggcccgtccccgtcgcccgtccgaacggtaacccg

SEQ ID NO: 386610 - DNA, 565 bp, Homo sapiens
  misc_feature: GZ8MTXP01CN3U0.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtgcaattatatggtatgataggaaagtaataaagactagtgtggactccgtaggaagggccgtattcaccatcctaccagacgaacaactaccaaagaacactctcgtttcaccaaatgaacaacgcctggagaggcgaggacacggcagtgtatactgtgcgagagatcgacagtacgaactaacggggtaaagttcgttttagattcgtacggtggggaccaaggggcaacgtcgtcctaccgtctcttcacgccctaccgaccgaacgggcccttacgttccgttcccttccccgcgtccgccctcgcctccgaagccg

SEQ ID NO: 386611 - DNA, 667 bp, Homo sapiens
  misc_feature: GZ8MTXP01E2ZVA.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtgggtggagtcggtggggggagcgtggtccagccgtggggacgtccctgagtacctctcctggtgcagcgtctggactcaccttcagtggctagtggcagtcgctacgtcggcctccccgacgacggccgtcccgggacggaagggggctgggggaggtggggtcgtactaagttatagtagggtataggaagtaaggtaaaagtaaacgtaaagtacttaaggtcgggtacggtaacggttacccgggtagggaaccggggtacctacttacccacgtaactccgtacccgaagaacgaaccaaacctaaccgaaacgtaacctaccgtttcttacgtttacctaaacccgtaaagtacgaaacgacgtccgtaaggaggacgggcggaacggaacgaccggattaaggtacgttaagttcgttggttcgaaggaagtaagtacgacgacgtaagttcggtaaaaccgg

SEQ ID NO: 386612 - DNA, 631 bp, Homo sapiens
  misc_feature: GZ8MTXP01DWGNP.22.86.H09.1.454.CMB.2.raw
  modified_base (229)..(229): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcgtccgggngaagggggctgggaggtgggtggactaatttatatggtatggaataggaaagtaaataaagactaatgtggactcgtgaagggccattcaccatctcagacgaacaactacaagaactactcttacgtttccaccaaatgaactaacgcctggagagggacgaggacacggcaagtgttatactggtgacgtaggaagactacgacagtacgaacgtaaacgggtaaacgttcgttttacgacgttcgtacggttacgggggacccgaaaggggtacctaaccgttcgggtacctacccggttcttcccttcgacgcccttacccgaaccgtaaccgggccccttacgttcccggttacccttcccccggcggccgtccccgtcgccttccgaacggtcccg

SEQ ID NO: 386613 - DNA, 627 bp, Homo sapiens
  misc_feature: GZ8MTXP01D2N8L.22.86.H09.1.454.CMB.2.raw
  modified_base (257)..(257): a, c, t, g, unknown or other
  modified_base (412)..(412): a, c, t, g, unknown or other
  modified_base (426)..(426): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggactaattanatggtatgataggaaagtaaataaagactaatgtaggactccgtagaaaggccgattcaccatctaccagacgaacaactaccaaagaacactcttcgttacctacaaatgaactagacctggagacgggacgagacgacggcagtgtattatgngagagacgatcganatagaacgtaaagggaattcgttttagacgttcgttacgggcggggaacccaaaggggtacctaacggttcggtaccgtaacccggttcttcccttaacgacggttaccctaccccgaacgtaaaccggggccccttaacgttcccgggtttccctcccccggttggccccgtcccgttgcccgttccgaaggggtccccg

SEQ ID NO: 386614 - DNA, 745 bp, Homo sapiens
  misc_feature: GZ8MTXP01CTZ02.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcgtccgggcgaaggggctgggaggtgggtgactaattatagtggtatggataggaaagtaaataaagactagtggtacggactccggtaggaaacgggcctaattcaacctatcctaccagaacgaacaactaccaaagaacctacttcttacgtttacctaacaaagtacgaaacaacgtcctggaaaggacgggacggaagggaccgacgggacgtaagttacgttaattacgtaggtagacggaagaggtactacggaactagtacgtaaacgttaacggggtaaacgttcggttttacggacgtttccgtacgggtacgggggaacccgaaacggggtaccgtaaccggttcggtacccgtaacccgttccttacccgttaaccgtaccgttcccgtaaccccgaaacccgggttaaacccgggccccttaaccggttccccggttacccccgtttccccccggtcggcccccggtccccgtaccgggttaccccgttaaccccggaacgggtaaccccg

SEQ ID NO: 386615 - DNA, 781 bp, Homo sapiens
  misc_feature: GZ8MTXP01DRHL1.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaaggggctgggagtggggtgacaattatagtggtatgataggaaagtaaataaagactatggtaggtactcggtaggaaacggccgattcaacctaatcctaccgaagagaaccaaacctaccaaaacgtaaaccacttacctttacgtttaccaaccaaaaagtacggaaaccaacgtaccgtcggaaaggaacgggaccggaaacggggaaccaacgggggctaaacgggtttagttaacgtttaaccgttgggtacggaccggtaaaggtaaacggaacttacgggaaccaaagtacggtaaacgttaaaccggggggaaatttccgggttttttaaggaaccgtttccgttacgggtaacgggggaaccccgtaaaaggggaccgtaaaccggttcggtacctaacccggttccgttcctttaacgaccgttaccccttacccgaaacccggaaacccggggtccccttaacggttcccgggttacccccctttcccccggtggcccccgttccccgtcgccccgttaaccccgaaggggtaacccccg

SEQ ID NO: 386616 - DNA, 658 bp, Homo sapiens
  misc_feature: GZ8MTXP01BKS15.22.86.H09.1.454.CMB.2.raw
  modified_base (281)..(281): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctgttggagtcgtgggggagcgtggtccagccgtgggacgtcctgagtactctcctgtgcagcgtntggacttcaccttcgagtggctagtcggcagtgctacgtggcctcccgccacgggccgtccgggggacgaacgggggtcctaggggtaggttggggtgtacctaagtttaactagttggtaatggaaagtagggtaaagttaaataaacggtacttaagtggtacggaccgttacggtagggaacggggtacccgtaagttccgaaccgtactcgtacccgaagaccgaacgtaaactaccgaaactaacctacttccgtacgttttccaaacctaaagttaccgaacgtacgcccgtaaggaacggacggacggaacggaccgtacggcgttaacggttgttaattacgtggtgacggttagaacgttcgtaacgg

SEQ ID NO: 386617 - DNA, 775 bp, Homo sapiens
  misc_feature: GZ8MTXP01ENEG7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactcggctccgccgaggcgtccgggcgaagggggctgggagtggggtgactaattatagtggtatgataggaaagtaaataaagtactaagtggtcggactccggtaggaacgggtaccgtatttccaacctactacgtacccaagaacgaaccaaacctaccaaacgaaactaccttctttaccgtttacctaaccaaaagttacgaaaccgtaacgacccgtaagggaagggaacgggaccggaaagggaacccgacgggtactaggttacgttaatttaccgtggtacgacggtaagggtaagtacgttacccggaaatacgttaacggaaaccggttaaacggggtaaacgtttccggtttttaagggacgtttaccggtaccggggttaccggggaaacccgggtaaacggggtacccgtaacggttccggtacccgtaccccggtttctcccgttaacccgtaacgttccccgtaacccgaaacccggaaaccgggtcccttaccggttacccgttccccgtccccgtcggccgtccccgtcgttccgtaacccgcggtaacccg

SEQ ID NO: 386618 - DNA, 604 bp, Homo sapiens
  misc_feature: GZ8MTXP01DJG5K.22.86.H09.1.454.CMB.2.raw
  modified_base (503)..(503): a, c, t, g, unknown or other
  modified_base (560)..(560): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtggggacgtccctgagtctctcctgtgcagcgtctggatccacttcgagtggctagtggcatgcacgtggcctccgccaggccgtcccggggacgaagggggctagggaggtggggtacgactaagtttatagtgggtataggacttaagggaaataaataaagactagtggtaggactcgtaggaacgggtccattccgaactatctacgagacgaacaactaccaaagtaacctacttacgttacgtttaccaaccgtaaaatcgtaaaccnggtacccgtaggaacggacggcggaaacggacacgggcgttagttcgttaattacgnggttacgaacgaagtcgacgtccgagtaacgttcggtaaaccgg

SEQ ID NO: 386619 - DNA, 657 bp, Homo sapiens
  misc_feature: GZ8MTXP01AO16I.22.86.H09.1.454.CMB.2.raw
  modified_base (224)..(224): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgctcttttaagaggtgtccagtgtcaggtgcagcgtggtggngtcggtggggagcggtggtccagccgtgggacgtccctgacgtactcgtcctggtgcagcgtcgtggtacttccaccttcgaggtggtctagtggcctagtgcacgtcggcctcccgacgacgggtccgtccgggacgaacgggggtctggggacgggtggggtcggactaagtttaagagtgggtatagtaaggtaagggtaaagttaaagtaaaagtacgttagtaggtacggtacgtcggtaaggacgggtaccgtacttaccactacgttacaccgagaaccgaacaaccgttaaccgaaacgaaacctaccttaccgttagtttaacctaaccgaaactaacggtaacacgtccggaagaacggaacgggacgacggaaccgtacggcgttagttacgtaagtcgtggtgacgagaagttaacgaacg

SEQ ID NO: 386620 - DNA, 710 bp, Homo sapiens
  misc_feature: GZ8MTXP01EATEC.22.86.H09.1.454.CMB.2.raw
  modified_base (432)..(432): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagcgtgggtggagtcggtgggggagcgtggtcagccgtggggacgtccctgatacctctcctgtcgcgagcgtcgtggtacttccaccgttcgaggtcgcttagtggctagtcgacctagtcggcctcccgacgaggccgtcgggacgaagggggctaggggaggtgggtgtactaaagtttaatagtggataggtagtaaacgggtaaaagttaaanaaagtacgtagtggtacggtaccgtacggtaagggaacgggtacctaattacccaactacgtacctaacgaacggaacgaaaccgtaaactaaccgaaaacgtaaccgttaccttccgtttacgtttaaccgtaacccaaagttacgaaaccgcgacccgtaaggaacgggaacggacgggaaacgggaaccccgaaggggttaccgttaaaggttacgtttaaaccggtttcgttaacggggaacgaacggttaacggaaggttaaccgtaacccgg

SEQ ID NO: 386621 - DNA, 687 bp, Homo sapiens
  misc_feature: GZ8MTXP01AJ2OV.22.86.H09.1.454.CMB.2.raw
  modified_base (227)..(227): a, c, t, g, unknown or other
  modified_base (254)..(254): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcacgtggctccgcaggcctccgggnaagggctgggagtgggtgactaattanagtggtatgataggaaataataaagctaagtgtaggactccggtagaaacgggtccaacttccaaccgattcctaccgaagacgaactaaacctaccaaagacctactcttacgttttaccaactaaatacgaacaaacgccctaaggaacggacgggacgacggaccgacggctagttacgtatacgtgtaggacgaagagactcgaactagtacgtaacgtaacgggtaacttacggtttacggaacgttcgtacgggttacggggaccgaaacggggaccgtaccgttcggtacccttaccggtccttccgttaacgccgttccctacccgaaacccgtaaccggggtccccttaccggtttcccggttccccttccccccggtcggtccccgtccccgttacgccccgttaacggaaccgggtaacccg

SEQ ID NO: 386622 - DNA, 692 bp, Homo sapiens
  misc_feature: GZ8MTXP01A1ZYA.22.86.H09.1.454.CMB.2.raw
  modified_base (272)..(272): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctcctgtgcagcgtctggatccaccttnagtggctagtggcagtcgcacgtggcctcccggccgagggcccgtacccgggggacgaaaggggggtccttagggggaggttgggggtcgaccctaaagtttagtagttggtaataggaagttaagggaaaacttaaaagtaaaagacgttagttagggtacgggtaccgttacccggtagggaaaccggggtcctacgtttacccgaaccctaacgttaccgttaacccgaagaaccgaaacccaaacccgttaaccgaaaccgaaccgtaccttacgtttaccgtttaaccctaacccgtaaataccgaaactacgccgtaggaacggacggacggaacggaacgacggtacttacggttgttaacgttcgttggttacgaacggagaagtagtaccgataacgttcggtaaaccggg

SEQ ID NO: 386623 - DNA, 562 bp, Homo sapiens
  misc_feature: GZ8MTXP01CG4OC.22.86.H09.1.454.CMB.2.raw
  modified_base (189)..(189): a, c, t, g, unknown or other
  modified_base (315)..(315): a, c, t, g, unknown or other
  modified_base (392)..(392): a, c, t, g, unknown or other
  modified_base (409)..(409): a, c, t, g, unknown or other
  modified_base (444)..(444): a, c, t, g, unknown or other
  modified_base (464)..(464): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggctccgccaggctccgggcaagggggctgggagtggggtggacaattatagtggtatgataggaaagtaaataaagactatgtgactcgtgaaggcgatcacatcncagacgacaactccaaagaacactctcgtttcacaaatcgaacaacgctgacgagcgagacacggcagtgtatacgngtgacgagagatacganagtagaacgtaagggaaatcgtttagatcttacgnggggaccaaggggactacgnggtacctaacgtcctcttcgacttcccgtaccaacgaacgggcccttacgttccggttcccttcccccgtggccctcccgtgccctccgaacgaaccg

SEQ ID NO: 386624 - DNA, 569 bp, Homo sapiens
  misc_feature: GZ8MTXP01B9GX6.22.86.H09.1.454.CMB.2.raw
  modified_base (335)..(335): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtggcaattatatggtatgataggaaagtaaataaagactatgtggactccgtgaaggccgattcacatctccagagacaactaccaagaacnctctcgtttcacaaatcaacaagcctgagacggacgaggacacgggcagtgttattactgtgcgagagatacgacagtacgaacgtaacgggtaaacgtcggtttttagacttccgtacggtacggggaccaagggactacgtcggtaccacctcgtcttccacgttcctacccgacgtaacgggcccacgttccgttacccttccccgtgccgccctcgcctccgcgggaacc

SEQ ID NO: 386625 - DNA, 634 bp, Homo sapiens
  misc_feature: GZ8MTXP01CS0LE.22.86.H09.1.454.CMB.2.raw
  modified_base (295)..(295): a, c, t, g, unknown or other
  modified_base (351)..(351): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggccgtccggggacgaagggggctgggaggtggggtggactaaattatagtggtatgaagtaggaaataaataaagntagtggtggacgtcgaggaacggcctatcacatcacagacacaactacaaagaacncttacttcgttacctaacaaatacgaaacacgcctaaggacggaggacgagacgacgatagtgtaatacgtgtgacgagagactacgacagtacgaacggtaacggtaaagttcgtttagacgttacgtcgggtacggggaacccgaaagggtcctaacgtcggtaccctaccgtacttcctaacgaccgccctacccgaccggtaaaccggccccttacgttcccgttaccccgtttccccgcggccccgtcccgtcgaccgttaacccgaaggtaaccccg

SEQ ID NO: 386626 - DNA, 608 bp, Homo sapiens
  misc_feature: GZ8MTXP01BRI7O.22.86.H09.1.454.CMB.2.raw
  modified_base (573)..(573): a, c, t, g, unknown or other
  modified_base (580)..(580): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgactaattatagtggtatgatggaaagtaataaagactatgtggactccgtagaagggccgattcaccatctacagacgacaactccaaagacactctagttctacaaatgaacaagcctgagaggcgagacacggcacgtgtatactgtgacgagagatcgacagtacgacgtaagggtaaactcggtttacgagttccgtacggtagggggtacccgaaaggggacctacgttacgggttacctaacccggttcctccgttaacgacgttccccgtacccgacgtaaaccgggcccttaacgttcccgggttacccttcccccggnggtcccncccgttcggccttccgaacggtaacccg

SEQ ID NO: 386627 - DNA, 812 bp, Homo sapiens
  misc_feature: GZ8MTXP01DWN6O.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggcctccgccgaggccgtcccggggacgaaagggggctggggaggtggggtggactaaatttatagtggtatgaagtaggaaagtaaataaagactaagtggtaggacctccggtaggaaacgggccgtaatttccaaccctatacctacccaaggaacgaaaccaaacctaccgaaaacgtaaacctacttcctttacgttttacccaaaccgtaaaaataccgaaaccgaaaacggcccgttaagggaaacgggaaacgggacccgggaaacgggaacccgaaccggggtacgtaaggttagttaattacgtaggtgacggaagacgaatacgaactagtacggtaacgtaaagggtaaacgttcggttttagaacgttccgttacggtccgggggaaccgaacggggtacctaaccgttcggtacccgtaacccggttccttaccgtttaaccgaacccggttcccctaaccccgttaaaccccggtaaacccggggtacccccttaaccggtttcccccgggttacccccgtttccccccggtccggggtcccccttcccccgtaggttccccggttaacccgaacggggtaacccccg

SEQ ID NO: 386628 - DNA, 613 bp, Homo sapiens
  misc_feature: GZ8MTXP01AD94C.22.86.H09.1.454.CMB.2.raw
  modified_base (191)..(191): a, c, t, g, unknown or other
  modified_base (254)..(254): a, c, t, g, unknown or other
  modified_base (271)..(271): a, c, t, g, unknown or other
  modified_base (312)..(312): a, c, t, g, unknown or other
  modified_base (517)..(517): a, c, t, g, unknown or other
  modified_base (538)..(538): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtncagctggtggagtcgtgggggagcgtggtccagcctggggagtccctgagactctcctgtgcngcgtctggatccacttnagtgctatggcatgcactggcctccggcagggcgtccgggngaagggggctgggaggtggggtcgacctaattagagtgggtataggagtttaagggaaacgtaaagtaaaagtacgttagttgggtacgggtaccgttacccggtagggaaacggggtcccgtaattaccaacccgtacttacctacccaaggaacgaccaaacctaccaaagaacctaccttcttacgtttaccaccttaaagngaaaccagccgtagagacggnggaacgaacgttcggacttggtagttaagttccttgggttgaacggagaagacgtccggaatgttcgtaaacggg

SEQ ID NO: 386629 - DNA, 701 bp, Homo sapiens
  misc_feature: GZ8MTXP01C3IYY.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggcgtccgggcaaggggctgggaggtggggtggactaattatagtggtatgaataggaaataaataaagactagtggtaggactcggtaggaacggccgtattacaccatcctaccagtaacgaaccaactaccaaacgaactacttcttacgtttacctacaaatcgaaacaacgccgtgaaggaagggacggaacggacgacgggactaggttagttaattacggtggtacgacggtagaagtaacgtcgaactagtacggaaacgttaacgggggtaaacttcgttttacggacgttccgtacgggttacggggaaccgtaaacggggactaaccggttcgggtaccctaccccggttcttacccttcgacccgaccccttacccgaaacccgaccggggtccccttacggtttccccggttaccccgtttcccccggaggtcccccgtcccttcggccctaaccggaacgggaaccccg

SEQ ID NO: 386630 - DNA, 735 bp, Homo sapiens
  misc_feature: GZ8MTXP01D6YIW.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtggcctccgccgaggcgtccgggagaagggggctgggaggtgggtggactaatttatagtggtatgagtaggaaagtaaataaagactatggtggactccggtaggaaacggcgtattacacctatctaccaagacaacaacctaccaaagaacctacttcttaccgttacctaacgaaatcgaaacctaacggcctgggaaggacgggaccggaaggaccgacggataggttgtaacgttcgtaggagtacggaagtaacgtacgtacgaactaggtacggaaacgggttaaacggggtaaagtttccggtttttaaggacgtttaccgttaccggggtacgggggtaacccgaaagggggtacccttaacggttcggtacccgttacccggttcctttccgttaaccgacggttaccccgttaccccgaaaccggtaaacccggggtccccttaacgggttcccgttcccccctttccccgggcgtccccgtcccgtcgttacccgtccggaacggtaaccccg

SEQ ID NO: 386631 - DNA, 846 bp, Homo sapiens
  misc_feature: GZ8MTXP01A4F66.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcgaaggggctgggagtgggtggctaattatatggtatgataggaaagtaaataaagactaagtggtaggaccgttaccggtaggaaacggggtcccgtaagtttaccaaccccgtaacttccgtaccccaaaggaacgaaaccctaaaccttacccaaaacggtaaacctaactttcctttaccggtttttaccctaacccgaaaaattacggaaaacccaaacgtaccccgttaagggaaagggaaccggggaacggaaacggggaaccgaaccggggtacgtaacggtttagttaaacgtttaccgtaggtacggacggtaaaggaagtacgtacgggaactacgttaacgggtaaaccgtaaacgggggtaaactttcgggtttttacggaacgtttccggtaccggtacggggggaaccccgtaaagggggtacctaaccggttcggttaccccgtaccgttccgttccttaaccgaccggttcccctaaaccccggacccggtaaacccggggtccccttaaccggtttccccgggttacccccgttttcccccggtccgggaaccccgttcccccgtcgggttacccccttaaccgggaaccggggtaacccg

SEQ ID NO: 386632 - DNA, 639 bp, Homo sapiens
  misc_feature: GZ8MTXP01BUFRR.22.86.H09.1.454.CMB.2.raw
  modified_base (264)..(264): a, c, t, g, unknown or other
  modified_base (618)..(618): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggaggtcgtggggggagcgtggtccagccgtgggacgtccctgagcctctcctgtgcagcgtntggatcacttcagtggctagtggcatgcacgtcggccctcccggaccgacgggccgtccgggggacgaagggggtcgtgggaggtggggtacgactaattagtagtggtatagaagtaagggaaagtaaacgtaaagtacgtaagtgggtacggtaccgtaccggtaggaacgggtcccgtattaccaaccgtactaccgtaccgaaggaacaaacctaaacctaaccgaaacgtaaactaccttactttacgtttacctaaacctaaagtacgaaacgacgccgtaaggacgacgggcggaaacggacgacgggacgttaagttagtaacttagttgttaggaacgagaaganacgactaagttaacgtaacgg

SEQ ID NO: 386633 - DNA, 627 bp, Homo sapiens
  misc_feature: GZ8MTXP01DTGCQ.22.86.H09.1.454.CMB.2.raw
  modified_base (389)..(389): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggaggtgggtgactaattatatggtatgaataggaaagtaaataaagactatgtggactcgtgaaggccgatcaccatctcagacgacaactacaagacactctcgttactaccaaatcgaacaagtcctggagacgggacgacggacacgggnagtgtattacgtgtgcgaagagatacggacagtagaacgtaacgggtaaagttcgtttagtacttccgtacggttacggggaccgaaagggacgtaacgttcggtaccctacccggttcctccgtttaacgacgttccccttacccgaccgaaacccgggtcccttaacgttcccggttaccccgtttcccccgtcgggtcccctccccgtcggttccttaacccgaacgggaacccg

SEQ ID NO: 386634 - DNA, 685 bp, Homo sapiens
  misc_feature: GZ8MTXP01DLPT0.22.86.H09.1.454.CMB.2.raw
  modified_base (540)..(540): a, c, t, g, unknown or other
  modified_base (619)..(619): a, c, t, g, unknown or other
  modified_base (625)..(625): a, c, t, g, unknown or other
  modified_base (664)..(664): a, c, t, g, unknown or other
  modified_base (677)..(677): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctagtggcatgcacgtggcctccgcgaggccgtccgggacgaaggggctgggaggtggggtgactaatttatagtggtatgaataggaaataaataagactagtggtacgaccgttcggtaaggaacggggcctaacttacaccctaattcctaccgaagaacgaaaccctaaacctaaccgaaaagtaaccctactttcctttaccgttttacccaaaccgtaaaagttacgaaaacctaacggacccttaaggggaaacggaaacggggaccgaaaggggaacccgaccggggtataaaggtttagtaaagtttacctggggtagaccgaagagtactaccganaagtaacgaaccggttaaagggaaatttcgttttagaattccgtacggacgggaacctagggacacgtcgtccgacctntctaanaccttccaccacgtacggccttaggttccttcctcccgngccgccctgaccncgaagccg

SEQ ID NO: 386635 - DNA, 665 bp, Homo sapiens
  misc_feature: GZ8MTXP01AS1U2.22.86.H09.1.454.CMB.2.raw
  modified_base (453)..(453): a, c, t, g, unknown or other
  modified_base (471)..(471): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcctccgggcgaaggggctgggagtgggtgacaattatagtggtatgatagggaaagtaaataaaagtactagtaggtggaaccgtccggtaggaaacggggccgtaagtttccaccatcctaccaagaacgaaccaaacctaccaaaacgaacctaaccttcttacgtttacctaccaaaatacgaaacaagaccctgaagagggacgaggactacggctagtgtattacgngtagcgagagatacgganagttagaacgtaacgggtaaagtcgttttagattacgtcggtaggggaccgaaaggggtaccacggttcggtaccgtacccgttcttaccgttccaacgttccccgtaacccgaccggaaaccgggccccttacggttccccgggttccccttcccccggtggccccgtccgtccgccctccggaacggtcccc

SEQ ID NO: 386636 - DNA, 736 bp, Homo sapiens
  misc_feature: GZ8MTXP01C0UUS.22.86.H09.1.454.CMB.2.raw
  modified_base (172)..(172): a, c, t, g, unknown or other
  modified_base (260)..(260): a, c, t, g, unknown or other
  modified_base (315)..(315): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtccctgacgactctcctgtgcagcgtnggtatcacttcagtgctatggcagtgcacgtggcctccgcgaggcgtcccggganaacgggggctggggacggtggggtcggtacctaagtttagtgtaggggttaataagggtaagttaacggggtaaaagtaaacgttaaaaaggtaccttaaggtcgggttaacggggtaacccgtacccgggtttaaggggaaaccggggttccggtaaacgtttcccaaaccccgtaacgttacccttaaccccgaaaggtaaaccggaaacctaaacccttaaaccgaaaaccgggttaaacccgtaacctttacccggttttacgttttaacccctaaccgttaaaaacgttccgaaaccgacggtacccgttaagggaacggaacgggccgggaaacggaaccgttacggaccgttagttagttacgttaacgttggttcggaagtagaagtacgtacgactaagttcgtaaaccggg

SEQ ID NO: 386637 - DNA, 778 bp, Homo sapiens
  misc_feature: GZ8MTXP01BYV8V.22.86.H09.1.454.CMB.2.raw
  modified_base (755)..(755): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtggcctcccgcgacgggccgtccggggacgaagggggctgggaggtggggtggactaattatagtggtatagagtaggaaagtaaataaagactagtggtacggaccgtccggtaggaacgggcctaacgttccaaccactctaccgaagaacgaaccaacctaccgaaagaactccttcgttccgtttaccaacaaagtcggaaacaacgcgtaaggaggacggacgggtaggaccgacgggtacgtaggttagttaacgttaacggtgggtacggaccgtaaaggaaacggtacgttaacgaccgtaaggtaaccgggtaaacgggtttaaaccgggggtaaaagttttcctttttaggggaaacccgttttccgggtaccggggttaaccgggggaaacccgtaaacggggtaaccctttaacggggtccggttacccctacccggttcgtaccttccgaccccgttacccttacccggaacccgtacccgggtaccccttcggttcccgttccccgttcccccggaggcccctacccgggtnaccccgtaacggaaccgaacccg

SEQ ID NO: 386638 - DNA, 644 bp, Homo sapiens
  misc_feature: GZ8MTXP01BV5QN.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggcaaggggctgggaggtgggtgactaattatagtggtatgataggaataataaagactatgtggactacgtagaacggcgattcacatctcagacgacaactacaacgaacactcttacgttcctacaaatcgaacaacgcctggagacgggacgacggacgacgggcagttgtaacttacgtggtagacgaagacgagtacgacagtagaacgtaacgggtaaattcgttttagacgttcgtacgggtacggggaccgaaacggggtctaaccggtcggtaacctacccggtttcttccgttaaccgaccgccccttacccgaacccggtaaccgggtaccccttacggttccccggttccccgtttcccccggcgggtccccgtccccgtggaccccgtcccggaacggtaacccgg

SEQ ID NO: 386639 - DNA, 572 bp, Homo sapiens
  misc_feature: GZ8MTXP01CNOL4.22.86.H09.1.454.CMB.2.raw
  modified_base (253)..(253): a, c, t, g, unknown or other
  modified_base (331)..(331): a, c, t, g, unknown or other
  modified_base (334)..(334): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtgacaattanatggtatgataggaaataataaagactatgtggactccgtagagggccattcacatctacagacacaactcaaagacnctntcgtttcacaaatgaacagcctgagaggcgagacacggctagtgttatactgtgcgagagtatcgacagtagaacgtaagggaaagtcgttttaggacttcgtcggtacgggggacccaaaggggacctaacgtcgggtacccaccgttactcctaacgacgccctaccgaaccgacgggcccttacgttcccggttaccctcccccggtggtcccgccctgaccctccgaacgggcc

SEQ ID NO: 386640 - DNA, 614 bp, Homo sapiens
  misc_feature: GZ8MTXP01B04JJ.22.86.H09.1.454.CMB.2.raw
  modified_base (451)..(451): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcacctttcagtggctatggcatgcactggcctccgccaggcgtccgggcgaaggggctgggagtgggtgacaattatatggtatgataggaaagtaaataaagactagtggtggacctccgtggaaacgggccattcaccatctaccagacgaacaacgtaccaaagaactactcttacgtttaccacaaatcgaaacaacgccctggaagagggccggaggaaccgacgggactagtagttaattacgtgtagacggagagatcgaanagtagaacgtaagggaatcggtttgaacgttcgtacggtacggggaccgaagggcctacgtcggtcctaccgtctcttcaccgccctccgaaccgtaaccgggcccttacgttcccggttccctcccccgtcggcccgcccgtcgcctccggaacgtaacccg

SEQ ID NO: 386641 - DNA, 598 bp, Homo sapiens
  misc_feature: GZ8MTXP01D64W9.22.86.H09.1.454.CMB.2.raw
  modified_base (336)..(336): a, c, t, g, unknown or other
  modified_base (457)..(457): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagttttgggctgagcgtggtttctcgttgcttcttttaagaggtgtccagtgtcaggtgcagctgggtggagtcgtgggggagcgtggtccagccgtgggagtccctgagctctcctgtgcagcgtctggtacttccaccttcaggtgctagtggcatgcatcggctccgcgaggcgtccgggngacggggcgtcggaggtgggtggactaagttaagtagttggtataggaagtagggaaaagttaaacgtaaagtagttaagtggtacgacggtccgtaggaaacgggtcctattccaactanacctacgaagacgaacctaacgtaccaaaacaaccttctacttacttaccttaaaccaagttacgaacctcgccgtaaggaggacggaccggaagaacggtccgagttgttactaagtacgtgcgagagaacgttgtaacg

SEQ ID NO: 386642 - DNA, 643 bp, Homo sapiens
  misc_feature: GZ8MTXP01CR7GG.22.86.H09.1.454.CMB.2.raw
  modified_base (219)..(219): a, c, t, g, unknown or other
  modified_base (313)..(313): a, c, t, g, unknown or other
  modified_base (316)..(316): a, c, t, g, unknown or other
  modified_base (332)..(332): a, c, t, g, unknown or other
  modified_base (343)..(343): a, c, t, g, unknown or other
tcagacatacgcgtcacgaccggtgctcgatttagtgctatagacttggggtttgggggggggtctcaggaggcagcactctcgggacgtctccaccatggcctgggctctgctcctcctcagcctcctcactcagggcacagggtcctgggcccagtctgccctgacccagcctgcctccgtgtctggatcatctggacagtcgatcagctatttccngcacgtgggaaccaaagagtggctagttgggttcttttgactctgtctcctagaaccaacaaccaccacgacccaaacccccatcatctattangtntcactcgtccgcctanaggtatctctnacgtcccgtcttctcgacgtcctaacaagtcgagaaccaaacgtacccgaccctacccctaaactactccttacgtcggtaccttccgtaagtttacggaagggttaacctagttaccttaactttaacttaactcgtacgttaacgggtttaacttttaaaacggttcggcccgtaccttaccgtcgtttcggtttacgggtttcggacgggagtacccacggtaacgtcgaccgttcgcggtacacgacccgaggcctccgcccccgtgtcctacgttccttccgttcccctaacccg

SEQ ID NO: 386643 - DNA, 633 bp, Homo sapiens
  misc_feature: GZ8MTXP01CXB9F.22.86.H09.1.454.CMB.2.raw
  modified_base (329)..(329): a, c, t, g, unknown or other
  modified_base (348)..(348): a, c, t, g, unknown or other
  modified_base (363)..(363): a, c, t, g, unknown or other
  modified_base (369)..(369): a, c, t, g, unknown or other
  modified_base (371)..(371): a, c, t, g, unknown or other
  modified_base (388)..(388): a, c, t, g, unknown or other
  modified_base (392)..(392): a, c, t, g, unknown or other
  modified_base (398)..(398): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcgtccggggcgaaggggctgggaggtggggtggactaattatagtggtatggataggaaagtaaataaagactagtgtggactcggtaggaaggccgtatcaccatcncagacacaactacaagacnctctcgttcacaatnaacaancngagaggacgagacacgnagtntatcgngtgacgtagagtatacgaacgatacgaacgtaacgggtaaagttcggtttttagaacgtttccgtacgggtacggggaaccgaaagggtacctacggtcgggtacctacccggttcttccttaaccgaacggttcccctacccgaacccgtaaccgggtccccttaacggttccccggttccccttcccccggtgggtccccgtccccgtcgttacccgtccgaaccgggaaccg

SEQ ID NO: 386644 - DNA, 655 bp, Homo sapiens
  misc_feature: GZ8MTXP01B69QN.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattccaccttcagtggctatggcatgcactggctccgcaggctccgggcaaggggctgggagtgggtggctaattatatggtatgataggaaagtaaataaagactagtgtggactcgtaggaacgggccgattccacatcctccagaacgacaactaccaaacgaacactcttacgtttacctacaaatgaacaagcctggagacggcgaggacacgggcagtgtattacgtgtgcgagagtagcgaacgatacgaacgtaacggggtaaagttcgttttaggaacgttccgtacgggtacgggggacccgtaaagggaccgtaccgtcgggtacctaccgttcctccgtttaaccaccggttcccctaccccgaaccgtaaccgggggtccccttacgggttcccggttcccccgttcccccggtcgggtccccgccccgttcgggttcccctaacccggaacgggtaaccccg

SEQ ID NO: 386645 - DNA, 632 bp, Homo sapiens
  misc_feature: GZ8MTXP01DW602.22.86.H09.1.454.CMB.2.raw
  modified_base (271)..(271): a, c, t, g, unknown or other
  modified_base (336)..(336): a, c, t, g, unknown or other
  modified_base (615)..(615): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgctcttttaagaggtgtccagtgtcaggtgcagctggtggagtcgtgggggagcgtggtccagccgtgggacgtccctgagactctccngtgcagcgtctggattcaccttcagtggctagtggcatgcactggctcccgcgaggcgtccgggngaaggggcgtgggaggtgggtggactaagttaatagtgggtatggaagtagggtaaaagtaaagtaaacgtattagtggtacggtaactccgggttaggaaacgggtacccgtaatttaccaaccactaccgttacccgaagaaccggtaaaccaaaccttacccgaaaagtaaccctacttcttacgtttacctaaccctaaagtacgaaaccacgtcccgtaagaagggcggacggaaacgggaacgaccggagttacgttagtaattacgtgtagngagaacggaataaccgg

SEQ ID NO: 386646 - DNA, 700 bp, Homo sapiens
  misc_feature: GZ8MTXP01AO29Q.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggacgtcctgacgactctcctgtgcagcgtctggtatccacttcagtggctagtggctatcgctacgtcgggccctcccggccgtacgggccgttaccgggggacgaaaggggggtcctacgggggtagggttgggggtcgaaccttaaagtttaagtagttggtagtacggaagttacgggtaaaagttaaagtaaagtacgttagtaggtacgggtacgtaccgggtagggaaacggggtcctaacgttccaaccgtacttacccgaccgaagaccgaaaccgtaaccttaacccgaaacggtaaccttaacctcgtttacgtttaaccctaaaccgtaaacgtacggaacctacggcccggtaagaaggacgggacgttacgggaacccgttacggccgttagttaggttaactacggttggtaccggaggagaacggaacgtaaccg

SEQ ID NO: 386647 - DNA, 573 bp, Homo sapiens
  misc_feature: GZ8MTXP01BLGNR.22.86.H09.1.454.CMB.2.raw
  modified_base (227)..(227): a, c, t, g, unknown or other
  modified_base (261)..(261): a, c, t, g, unknown or other
  modified_base (311)..(311): a, c, t, g, unknown or other
  modified_base (316)..(316): a, c, t, g, unknown or other
  modified_base (389)..(389): a, c, t, g, unknown or other
  modified_base (393)..(393): a, c, t, g, unknown or other
  modified_base (397)..(397): a, c, t, g, unknown or other
  modified_base (406)..(406): a, c, t, g, unknown or other
tcagacatacgcgtcacgaccggtgctcgattttagtgctatagacttgggtttgggctgagctgggttttcctcgttgctcttttaagaggtgtccagtgtcaggtgcagctggtggagtctggggtaggcgtggtccagcctgggaggtccctgagactctcctgtgcagcgtctggattcaccttcagtggctatggcatgcactggctccgcaggctccgggnaaggggctgggagtgggtgctaattatatggtangataggaaagtaataaagactatggtgactcgtgaaggccatcaccatcncaganacacgtacaaagaactactctagtttccacaaaatgaacagcctggagaggcgagtacagggcagtgtatacngtgngaanagatcgaanagtagaacgtaacggtattcggttagacgtcgtacggacgggacgaacggtacgtacgtcgtacctccgtctcctcgaccgttccctaccgaccggtaaccggtcccttacggttcccgttaccccgttcccgcggtcccgtcccgtcgacccgtaaccgcggaacc

SEQ ID NO: 386648 - DNA, 602 bp, Homo sapiens
  misc_feature: GZ8MTXP01A5LDG.22.86.H09.1.454.CMB.2.raw
  modified_base (271)..(271): a, c, t, g, unknown or other
  modified_base (563)..(563): a, c, t, g, unknown or other
  modified_base (575)..(575): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtcctgagactctcctgtgcagcgtctggattcaccttnagtggctagtggcatgcacgtcggcctcccgcgaggccgtcccgggagaagggggtctgggaggtggggtagacctaagttagtagtgggtataaggaagttaagggaaaattaaagtaaagtactaggtcggtacggtaaccgttccggtaggaacggggcctacttccgaactactctaccgaacgaacgaaccaaacctaccaaacgtactacttacttacgttaccaacaaagtcgaacacgcctaggacgacggcgaaggacgacgggcttaggttagtaattacgngttacgcgaggngtacgacgactaagttaacggaaacgg

SEQ ID NO: 386649 - DNA, 712 bp, Homo sapiens
  misc_feature: GZ8MTXP01BGMVX.22.86.H09.1.454.CMB.2.raw
  modified_base (517)..(517): a, c, t, g, unknown or other
  modified_base (585)..(585): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgccacgtggcctccgccgagggccgtccgggacgaagggggctggggaggtggggtggactaattatagtggtatgataggaaagtaataagactagtgtaggactcggagacggccattccactatcctacaagacgaacaacacaaacgaactacgtcttaccgttacaaccaaagtacgaaccaacggacctaagggaacgacgggacggaacggacgacgggtctagttagttacgttacgtggtcggacgaggtaacgtacgtacgaactaggtacgaaaccggttaacgggtaaagttcggtttaanacggttcgttacggggacgggaaccgtaagggctacggttcgtcccgtaacccgtttctccgtaaccnccgggttcccctaaccgaaacccgggtaccgggtaccccttacccgggttccccggtttaccccgttccccccgggtcggtcccccgtccccgttcgggaccccgttaacccggaaggggtaacccc

SEQ ID NO: 386650 - DNA, 701 bp, Homo sapiens
  misc_feature: GZ8MTXP01BQ9LR.22.86.H09.1.454.CMB.2.raw
  modified_base (682)..(682): a, c, t, g, unknown or other
  modified_base (696)..(696): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggctccgggacaaggggctgggagtggggtggcaattatagtggtatgatggaaataataaagactaagtgtggactcgtaggagggccgattcaccatctccagacgaacaactccaaagaactacttcttacgtttacctaccaaaatacgaaaccaacgtacccgtaaggaacgggaagggaccgggaaagggaacccgaaccggggacgtaagggtttacgtttaattaaccggtgggttagggacggaaaggtaacggtaacgttaccgaacgtaagttacggtaaaccggttaaacgggggtaaacttcggttttttaacggacgtttaccggtacggggttacgggggaaccctaaacgggggtacctaacggttcggtaccgtacccgttctccgttaacgaccgttcctacccgacgaacgggtccccttagttcccgttccctccccgcgccncctcgccgtaacgnggccc

SEQ ID NO: 386651 - DNA, 552 bp, Homo sapiens
  misc_feature: GZ8MTXP01B9M2H.22.86.H09.1.454.CMB.2.raw
  modified_base (252)..(252): a, c, t, g, unknown or other
  modified_base (328)..(328): a, c, t, g, unknown or other
  modified_base (546)..(546): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtgcaattanatggtatgataggaaagtaataaagactatgtgactcgtgaaggcgattcacatctcagagacaactacaagaacnctctcgttcacaaatcgaacagcctggagaggcgaggacacggcagtgtatactgtgcgtagagactacgacagttacgaacgtaacgggaagttccggttttagaattccgtacggtacggggaccaaggggacacgtcggtcctacgttctcttcacgttcctaccacgaacggtccacgttccgttcctccccgtaggccctccgcgttctccgngaaccg

SEQ ID NO: 386652 - DNA, 616 bp, Homo sapiens
  misc_feature: GZ8MTXP01CF08C.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcacctttcagtggctatggcatgcactggctccgccaggctccgggnaaggggctgggagtggggtgctaaatttatagtggtatgaattaggaaagtaaataaagactaatggtaggactccggtgaaagggccgtattcaccgatctccagagacaactccaagaacactctcgtttcacaaatgaaacagccctgaagagggcgaaggacacggcagtgtattactgtgcgagagatcgacagtacgaacgtaacgggtaaagttcgttttagacgttcgtcgtacggggacccgaaggaccgtaacgtcggtaccgtaccgttcctcttccaacggttccctaccgaaccgaaaccgggccccttaacgttcccggttcccctttcccccgcggtccccgtccccgtcgttcccgttccgaacggtaacccg

SEQ ID NO: 386653 - DNA, 577 bp, Homo sapiens
  misc_feature: GZ8MTXP01CU6NI.22.86.H09.1.454.CMB.2.raw
  modified_base (378)..(378): a, c, t, g, unknown or other
  modified_base (405)..(405): a, c, t, g, unknown or other
  modified_base (417)..(417): a, c, t, g, unknown or other
  modified_base (555)..(555): a, c, t, g, unknown or other
  modified_base (564)..(564): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggcctccgggcaaggggctgggagtggggtggactaattatagtggtatggataggaaagtaaataaaagactatggtaggactccgtaggaaacggccgattcaccatctaccagaacgaacaactacaaagaacactctcgttcacaaatgaacagcngagagacgagacacgcagtatatacgngtgacgagaagntacgaactagtacgaacgttaacgggaaattcgtttagatcgtgtacgggggacctaaagggccaacgtcggtacctaccgtcctacttcacgccctaccgaaccgtaacggcccttacgttcccgttccctccccgngcccgtccngcctccgaaggcc

SEQ ID NO: 386654 - DNA, 678 bp, Homo sapiens
  misc_feature: GZ8MTXP01A040T.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggagtccctgagactctcctgtgcagctctggatcacttcagtgctatggcatgcacgtggcctccgccgaggccgtccgggacgaacgggggcttagggaggtggggtcggactaagttagtagtaggtatgaagtaagggaaactaaataaagactagtcggtaggaccgtccgtaggaacggggtaccctacttacccaccctaacgtaccctacgaaacggaaccgaaacctaaacctaaccggaaactaaccgtactttaccgtttaacgtttaccctaaaccgtaaacgttaacgaaacgtacgtaccgtaagggaaacggacgggaaccggtaacgggaaccgaacccgggtattacgggttaagttaccgttaagttccgggttagtaaccgggaaggaagtacgtaccggttataacgggttaacggttaaaccgggg

SEQ ID NO: 386655 - DNA, 622 bp, Homo sapiens
  misc_feature: GZ8MTXP01BBNZD.22.86.H09.1.454.CMB.2.raw
  modified_base (403)..(403): a, c, t, g, unknown or other
  modified_base (589)..(589): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggctccgggcgaaggggctgggaggtgggtgactaattatagtggtatgataggaaagtaaataaagactatggtaggactccggtaggaaacgggccgtattcaccatctaccagacgaacaactaccaaagaacactcttcgttacacaaatgaacaagcctgagaggacgaggacgacggnagtcgtattacgtgtgacgagagtacgtacgacaagtacgaacgtaacggggtaaattcggttttagacgttccgtacggtacggggaccgaagggtacctaacgtcggtacctaccgtcttccttaacgaccgttccctacccgaaccgtaaccgggtcccacgttcccggttcccttcccccgnggtccccgccctcgcccgtaacgaacggaaccg

SEQ ID NO: 386656 - DNA, 756 bp, Homo sapiens
  misc_feature: GZ8MTXP01EWPFV.22.86.H09.1.454.CMB.2.raw
  modified_base (261)..(261): a, c, t, g, unknown or other
  modified_base (434)..(434): a, c, t, g, unknown or other
  modified_base (440)..(440): a, c, t, g, unknown or other
  modified_base (475)..(475): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggcctccgggcaagggggctggggagtggggtggataattanatggtatgaataggaaagtaaataaagactagtggtagaccgtccgtaggaacgggccgtacttccaaccactcctaccaagacgaacaaacctaccaaagaactactcgttactttacctaaccaaatacgaaacaacgaccgtgacgggaagggcgaacggaccgacgggnaagttntaagttacgtggacgagaagaggtacgtaccgaanagtacgaaaccggttaaagggtaaccgtttcgttttagacgttaccgtcggggtacggggaaccccaaaggggttaccaacgggtttccggtaaaccctacccggttcccttacgttaaccgaaacccgttcccccggttaaacccgaaccccggttaaaacgggggcccccccttaagggtttccccccccgggttcccccgttttaaccccccccgggcgggttccccgggccccccttcggggaaacccccgtttcggaaccccgggggtaacccccg

SEQ ID NO: 386657 - DNA, 660 bp, Homo sapiens
  misc_feature: GZ8MTXP01AS5BW.22.86.H09.1.454.CMB.2.raw
  modified_base (598)..(598): a, c, t, g, unknown or other
  modified_base (635)..(635): a, c, t, g, unknown or other
  modified_base (640)..(640): a, c, t, g, unknown or other
  modified_base (654)..(654): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcgtccgggcaaggggctgggaggtggggtggcaaattatatggtatgaagtagggaaagttaaataaaagactaagtggtcggactccggtggaaacggggcctatttcaaccatacctccgaagacgaaccaaactccaaagaacctactcttacgtttaccacaaaatcgaaaccaacggtccctggaacgggacgggacggaacgggaccaacggggactagttagttaacgttacgtagggttacggacggaaggaaggaacgttacgaaccgtaagttacgtaaacggttaaacgggtaaaacgttcggtttagtacgttcgtcggtacggggaccgaaacgggactacgtcggtcctaccgtctcttcgacnccctccaccgaacggtccacgttccgttcctccccgnggccnccctgcctaaccgngaaccg

SEQ ID NO: 386658 - DNA, 746 bp, Homo sapiens
  misc_feature: GZ8MTXP01CLGYH.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtggcctccgccaggccgtccgggcgaaggggctgggaggtggggtgactaaatttagtagtggtatggaattaggaaataataaagactaagtggtacggtacctccggtaggaaacgggccctatttaccgacctactctaccgaagacgaaccaaacctaccgaaacgtaaacctctttactttaccgtttacccaaacctaaaatcggaaaccacggtacccgtaagggaagggaaacgggacggaaacgggaaccgaccgggtacttaagggttagttaacgtttaacgtgggtacgacggaagaacggtataccgaatagttaacgaacgttaaacggggtaaatttcggtttagaacgttccgtacggggtacgggaacccgaaaggggtacctaacggttccggtaccctaacccgttcgtcccttaaccgaccgttcccgtaacccgaccggtaaaccgggtccccttaggttccccgttccccgttccccgtgggcccctcccgtcgccgtaacccgaagggaacccc

SEQ ID NO: 386659 - DNA, 691 bp, Homo sapiens
  misc_feature: GZ8MTXP01EQXD1.22.86.H09.1.454.CMB.2.raw
  modified_base (228)..(228): a, c, t, g, unknown or other
  modified_base (422)..(422): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggnaaggggctgggagtgggtggactaattatatgtatgagtggaagtaataaagactaatggtgactccgtgaaaggccgatcaccatctaccagacgaactaactaccaaagaacacctcttacgtttacctacaaaatgaaaccaagccctaaggacgagggacgagggaaccacgggactagtagtattacgngtagacgagaagtactacgacagtacgaaacgttaacgggaaagttccggttttagacgttacgttacggtacgggggaccctaagggggtaccaaccgttcggtaccgttaacccggttcttccgttaaccgaacgggttacccctacccgaaacccggaaacccgggtaccccgttaccgttccccgggtttccccgtttccccccggtttccggggccccgtacccccgttcggccccgtttaaccccggaacggggtaaccccgg

SEQ ID NO: 386660 - DNA, 698 bp, Homo sapiens
  misc_feature: GZ8MTXP01EGHFP.22.86.H09.1.454.CMB.2.raw
  modified_base (256)..(256): a, c, t, g, unknown or other
  modified_base (284)..(284): a, c, t, g, unknown or other
  modified_base (287)..(287): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggcctccgggcaaggggctgggagtggggtgacaattanagtggtactgataggaaagtaataaagntangtgactcgtgaaggcatcaccatctcagacgacaactccaagaacacttcttacgtttaccactaaaatcgaaacccacggcccttaagggaacgacgggacggaacgggaaccgacggggtactaaggttagttaagtttaaccgtggttacgcggtaaaggtaacgtacgtcgaacgagttacggaacgttaaccgggggtaaattcggttttagacgttgtaccggtaggggacccgtaaaggggtacctaacggttcggtaaccgtacccggttaccttccgttaaaccgcgttaccccttacccggaaaccgtaaccccggggtcccttaacccgttccccggttccccgttccccccgttcgggccccgtccccgtacgccccgttaacccgaacgggtaacccg

SEQ ID NO: 386661 - DNA, 687 bp, Homo sapiens
  misc_feature: GZ8MTXP01EQMI4.22.86.H09.1.454.CMB.2.raw
  modified_base (227)..(227): a, c, t, g, unknown or other
  modified_base (264)..(264): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgcgggaggcgtggtccagcctgggaggtccctgagactctcctgtgcagcgtctggattcaccttcagtggctatggcatgcactggctccgccaggctccgggnaaggggctgggagtgggtggctaaatatatgtatganaggaataataaagactagtgtaggactccggtaggaaggccgtattccaacatcctaccagactaacaactaccaaagacacttctagtttacacaaatgaaaacagccgtagaagacgggacgagggaccacgagtagtattattacgtgtagcgaagtagactcgaatatacgtaacgtaacggggtaaatccgtttttaggaacttcgttacggtacgggggaccctaaagggggaccctaaggtccgggtttacccaaaccggtttccgtaactttccgaaacggtttcccccgttaaaccccaaacccgggtaaacggggcccccctttaacgttccccgggtttaacccccctttccccccgggttcgggggtccccccgtccccggttaccggtaaccccgttaaccgggaaccgg

SEQ ID NO: 386662 - DNA, 696 bp, Homo sapiens
  misc_feature: GZ8MTXP01BNAKH.22.86.H09.1.454.CMB.2.raw
  modified_base (192)..(192): a, c, t, g, unknown or other
  modified_base (218)..(218): a, c, t, g, unknown or other
  modified_base (233)..(233): a, c, t, g, unknown or other
  modified_base (269)..(269): a, c, t, g, unknown or other
  modified_base (398)..(398): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccngcagtgatggttggtgttaataactntgtctctgtaccaangccaccaggacaaacgccccagactcatctatttangctgtacaataacgccggccctcgacgggtccctgactcgtctttctcgtcggctaccagtctggaccaaccgccggtcctcccgtcgaccctaatcctcggtcggcctaccgaggtctaggaaacgtntgacgtcttagtaatttacttacgtgtcttcgtcttacgtagtttcggacgtaccgggtaccgtaccgttaacggttccgggtttcgggggttacggttacccgggggaccggggaacggggtaaacccgtaacgggtcccgttaccgggtaccccgttaccggtaacgggttacccgaaccggaccccgttaaacgggtccccgttcccggttccccccgttcggttaccccttaacccgttcccgttccccggtttacccccaccccgtttaccccgtccgttaacccggttccgg

SEQ ID NO: 386663 - DNA, 600 bp, Homo sapiens
  misc_feature: GZ8MTXP01CAYYI.22.86.H09.1.454.CMB.2.raw
  modified_base (266)..(266): a, c, t, g, unknown or other
  modified_base (340)..(340): a, c, t, g, unknown or other
  modified_base (349)..(349): a, c, t, g, unknown or other
  modified_base (355)..(355): a, c, t, g, unknown or other
  modified_base (379)..(379): a, c, t, g, unknown or other
  modified_base (397)..(397): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaacagcacccaggcaaacgcccccagacncatcatttatgctgtcaataagccggccctcgacgggggtccctgactcgctttctctgctccagtctcgcacncgccctccngacccntctcgtgggcctcgaggctagagntgaggctgatttattacngtctgtctctagtttcgacgacgggtccgtcctacgtacgtttggggttcggttccgggagggtacgggacctaacggccgtacggtaaccccggttacggttacgggtcccacggaccccgtaagggttcccgttcccggacccccccgttcgggtccctccgttccccgttccggtttaccccccaaccccgttccctccg

SEQ ID NO: 386664 - DNA, 740 bp, Homo sapiens
  misc_feature: GZ8MTXP01EPVI0.22.86.H09.1.454.CMB.2.raw
  modified_base (254)..(254): a, c, t, g, unknown or other
  modified_base (262)..(262): a, c, t, g, unknown or other
  modified_base (275)..(275): a, c, t, g, unknown or other
  modified_base (292)..(292): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggagtcctgagactctccgtgngcagcgtntggattcaccttnagtggctatggcatgcncgtcggcctcccgcgacggccgtaccggggacgaacgggggtccgtaggggtacgggttggggacggtactaaagtttataggttggtaagtgaagtagggaaaaaattaaagtaagtactagttacggtcgggaaccgtcgggtaagggaacgggaccgtacttaccgaaccgtacttaccgaccgaaacggaaaccgtaaaccctaaacgttaaccccgaaaacgtaaacccttaaccgtttccctttacggttttaacctaaacccgtaaaacgttacggaaaaccaccggtaccgttacgggaaacggaacggggtaccgaaacgggtaaccggaacggtaaccgttaaggttacgttaaacggtttacgtacgggtaggacgttaggaagtaacctacggaactaggtaccgaaacgggtttaaacggttaacgttttaaccg

SEQ ID NO: 386665 - DNA, 586 bp, Homo sapiens
  misc_feature: GZ8MTXP01EWLUA.22.86.H09.1.454.CMB.2.raw
  modified_base (231)..(231): a, c, t, g, unknown or other
  modified_base (403)..(403): a, c, t, g, unknown or other
  modified_base (411)..(411): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggccgtccgggngaaggggctgggagtgggtgactaattatagtggtatgaataggaaagtaaataaagactaatggtggactccggtggaaacgggccgattcaccatctccagacgaacaactaccaaagaacactctacgtttcacaaatgaacaagcctgagaggcgagacacggcagtntattacgngtgacgagagatcgatagtcgaacgtaacgggaattcgttttagacttcgtacgggtaggggacccgaaggggtactacgttcgggtcctacccgttctcgttcacgccctacccgacgaacggtcccttacgttcccgttcctccccgtggccctcctcgcctcgaacggaacc

SEQ ID NO: 386666 - DNA, 810 bp, Homo sapiens
  misc_feature: GZ8MTXP01DPFX2.22.86.H09.1.454.CMB.2.raw
  modified_base (193)..(193): a, c, t, g, unknown or other
  modified_base (233)..(233): a, c, t, g, unknown or other
tcagacatacgcgtcacgaccggtgctcgatttagtgctatagacttggggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccngcagtgatggttggtgttatactatgtctctgtaccaacngcaccaggacaaacgcccccagactacatctatttatgctgtacaagtaacgccggcccctcgacggggtccctgtacttccgtctttcctcgtcggcctaccgtaacgttcgtacggacctaaaccccgacccggtcctccttcctacggtaaacccctattcccgttccgtcgggggtacccttaccccgagggtaccgttagggaaacgagttagggaacgggtcttaggttaattttaacgttacgttcggtactccggtacttttttcgaagttttcggacccgtacggggggtaccccttacccgtttaaaccgttaccggggttttcgggggttccggggtttacccgggggaccgggggttaaaccggggtaacccgtaaaccgggttcccggtaccgggttaaccccggttaaccggttaaccggttccggaacccggttaaccccggaaacgggttccccggttaccccggttccccccccgggtttcgggttccccttacccggtttcccgtttccccgggttcccccccgttacccctttaaccccgttccccgtttaacccggg

SEQ ID NO: 386667 - DNA, 633 bp, Homo sapiens
  misc_feature: GZ8MTXP01B39XX.22.86.H09.1.454.CMB.2.raw
  modified_base (554)..(554): a, c, t, g, unknown or other
  modified_base (604)..(604): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttctttttaagaggtgtccagtgtcaggtgcagctgggtggagtcgtgggggagcggtggtccagccgtgggacgtccctgagctctcctgtgcagcgtcgtggtacttccaccttcgaggtcggctagtcggcagttcgctacgtcggccctcccggccgagggcccgtaccgggggagaacggggggctggggacggtcggggaggtactaagtttaagtagtggtataggtagtaaggaaacgtaaataaagacttagtggtcggtactccgggtagaacggggtacctattccgaccattccacgaaggacaaccgaactaccgaagtaactccgttacttacgtttaccaaacgtaatacggaanaccggtctaaggaaggacggacggacgtaacgacggcgttagttacgttntacggtgtacggcgaagtggttaacaacg

SEQ ID NO: 386668 - DNA, 676 bp, Homo sapiens
  misc_feature: GZ8MTXP01C0VAF.22.86.H09.1.454.CMB.2.raw
  modified_base (239)..(239): a, c, t, g, unknown or other
  modified_base (264)..(264): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaangccaccaggacaaacgccccagacncatctattatgctgtacaataacgccggccctcgacggggtccctagactcgtctttcgtctcggctacagtctcgacaacgcgtccctcctacgacctctctcgtcgggcctccgaggtctagaagtacgtggacggtctaggtaactttacgtttacgtcgtccgttgtccttacgttagtttccggacggtacgggtccgtaccttaacgtacggtttcggggtacgggttccggggaccggggaacgggtacccgtaaacggtcccggttaccggtaaccccggttaccgttacgggtacccgaccggtaaaccccgtacgggttccccgttcccgggttccccccgttaacgggtaccctaaccggttcccgttcccggttaccccctaaccccgttcccgtcccgg

SEQ ID NO: 386669 - DNA, 662 bp, Homo sapiens
  misc_feature: GZ8MTXP01A3ALU.22.86.H09.1.454.CMB.2.raw
  modified_base (627)..(627): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcacgtggcctccgcaggctccgggcaagggggctgggaggtggggtgactaattatagtggtatgataggaaataaataaagactatggtgactcggtagaacggccgatccactatctaccagacgaacaactaccaaagaactactcttacgttactaaccaaatacgaaacaacgaccctggaacggacgggacggacgggaccgacgggactaaggttagtattaccgtggtggacgagaagtactcgaactagtaacgtaacggtaaagggtaaacttcgttttaggacttcgtacgggtacgggggaacccgaaaggggtacctacggttcggtacccaccggtttctccgttaacgccgttacccctacccgaccgtaaaccgggtcccttacgttcccggttaccccttccccggnggccccgttcccgcgacccgtccgaacgggtcccg

SEQ ID NO: 386670 - DNA, 692 bp, Homo sapiens
  misc_feature: GZ8MTXP01EIY6G.22.86.H09.1.454.CMB.2.raw
  modified_base (230)..(230): a, c, t, g, unknown or other
  modified_base (249)..(249): a, c, t, g, unknown or other
  modified_base (259)..(259): a, c, t, g, unknown or other
  modified_base (658)..(658): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattccaccttcagtggctatggcatgcactggctccgccaggctccgggngaaggggctgggagtgggngctaaattanagtggtatgataggaaataaataaagctatggtgactcgaggaacggccattccacctatctaccagacgaacaactaccaaagaactacctacttagtttacctaaccaaattcgaaacaagacctggaaacggacgggacgaacggaaccgtacgggactaaggttattagttaacgtgggtagaggtaagaaggtaacgtacggaaactaacgtaagggtaaacccggttaaagggggtaaaacgtttcggtttttacggaagtttcccgttagggtacgggggaaccctaaaagggggtccaacggttgtacccgtaccgttctacctcgtacccacccgtacccaaccggaaccgggtccccttacggttccccggttccctttaacccccggnggtcccctcccgtgcccttcccggaagggtcccg

SEQ ID NO: 386671 - DNA, 733 bp, Homo sapiens
  misc_feature: GZ8MTXP01EZ26I.22.86.H09.1.454.CMB.2.raw
  modified_base (711)..(711): a, c, t, g, unknown or other
  modified_base (726)..(726): a, c, t, g, unknown or other
tcagacatacgcgtcacgaccggtgctcgatttagtgctatagacttgggtttgggctgagcgtggttttctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggccgtccgggcgaaggggctgggagtgggtgactaaattatagtggtatggaataggaaagtaaataaagactagtggtaggactccgtaggaacgggccgtattccacctatcctaccgaagaacgaactaaacctaccgaaacgtaaacctactttacgtttaccgttttacctaaacctaaaaagttacgaaaacccaacggacccgttaaggggaaacgggaacggggaccgggaaagggaaacccggttaacgggacgtaaggttagttaacgttaagttgggtacgaggaaggtaacggacttacgaaacgagtaacggtaaacggtaaccggggtaaagtttccggttttaaggaacgttccgtacgggtacggggaaccgaagggactacggtcgtaaccgtcctacttcgttcgaacgttcccctacccaaccggacgggtaccccttcgttcccggttcccttaacccccgtgccccgtccncggttcctaaccggngaacccg

SEQ ID NO: 386672 - DNA, 799 bp, Homo sapiens
  misc_feature: GZ8MTXP01CPZHX.22.86.H09.1.454.CMB.2.raw
  modified_base (229)..(229): a, c, t, g, unknown or other
  modified_base (265)..(265): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggcctccgcaggctccgggnaaggggctggaggtgggtgactaattatagtggtangataggaaataataagactagtggtcggaaccgtccggtaggaacgggtcccgtaatttcccaaccgtacttccgtacccgaaggaacgtaaacccaaccgtacccaaaagtaaacctacttccgtttaccggttttacccaacctaaaagttacggaaacccaaaaccggtcccgttaagggaacggaacggggacccggaaacggggaaccgaccggggactaaagggttcgtttaacgttaccgttagggtacgacggaaaggtacgtaacgttaccggaaccgtaagtaacggtaaccggttaaacggggttaaaacgttccgtttttaggtacgttccgtaccgggtagggggtaccccgaaagggtaccgtaccgtcggtacccgtacccgttccgttcgttccgaaccgcccgttaccccaacccggtaaacccggggtccccttaacccggttcccgggttcccccttccccccggttcgggccccgtccccggttcggaccccgttaacccgaaggggaaccccg

SEQ ID NO: 386673 - DNA, 745 bp, Homo sapiens
  misc_feature: GZ8MTXP01AWUS2.22.86.H09.1.454.CMB.2.raw
  modified_base (188)..(188): a, c, t, g, unknown or other
  modified_base (263)..(263): a, c, t, g, unknown or other
  modified_base (288)..(288): a, c, t, g, unknown or other
  modified_base (720)..(720): a, c, t, g, unknown or other
  modified_base (731)..(731): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttnagtggctatggcatgcacgtggcctccgccaggccgtccgggacgaagggggctgggaggtgggtgactaattanagtggtatagagtaggaaagtaaanaaagtactagtaggtggaccgtaccggtaggaaacggtcccgaatttaccaacctatacctacccaaggaacgtaaccaaacctaccaaacgaacctcgttactttaccgttacctaacaaaagtacgaacgtaacgaccgtaaggaacgggaacgggaccgggacgggtaaccgacgggtacgttaaaggtacgtttaaacgttaacggtgggtacggtacgaaaggtaacgtcggtaacgaaccggtaagtaccggtaaacgttaaacgggggttaaactttcgggttttaagacggttaccgttacggggccggggaaacccgtaagggtacctaaccggttcgtaacccgttaccgtctttcccgtaacacgggtttcccacccgttaacggaaccggtcccttaccgttcccgttccctaaccccgnggcccttaccngccctcgaagtccg

SEQ ID NO: 386674 - DNA, 668 bp, Homo sapiens
  misc_feature: GZ8MTXP01EH6VT.22.86.H09.1.454.CMB.2.raw
  modified_base (431)..(431): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagctgggtggagtcgtgggggagcgtggtccagccgtgggacgtccctgacgactctcctgtgcaggcgtcgtggtacttccacttcaggtggctagtggcatcgaccacgtcggacctcccggaccgaggtccgtcccggggagaagggggccttaggggaggtgggtagactaaagttaagtagtgggtaatagggaagtaggaaaacgttaaanaaacgtactagttgtaggtacgtaccggtaggaaacgggtcctaaacttccaacctattcccacgaaagtacaaccgtaaactacccaaagaacctccttacgttcgtttaccaaacctaaagtaccgaaactcggtcccgtaaggaacggacgggacggaaacggaaccgtacgggttacgttaggtttacgttaagtaccgttgggaggaccgttaaagggcttaacgtaaccgg

SEQ ID NO: 386675 - DNA, 507 bp, Homo sapiens
  misc_feature: GZ8MTXP01AQJBU.22.86.H09.1.454.CMB.2.raw
  modified_base (311)..(311): a, c, t, g, unknown or other
  modified_base (338)..(338): a, c, t, g, unknown or other
  modified_base (372)..(372): a, c, t, g, unknown or other
  modified_base (382)..(382): a, c, t, g, unknown or other
  modified_base (447)..(447): a, c, t, g, unknown or other
  modified_base (468)..(468): a, c, t, g, unknown or other
  modified_base (478)..(478): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggatcaccttcagtggctatggcatgcactggctccgccaggcgtcccgggnaagggggctggaggtgggtggccaatntagtggtatgaatgggaaagtaataaagactagngtagactcgngaaggcattcacatcacagagacaactacaagacactctgttacacaaatgaacacgcctgacgnggcgaaggacacgggcacgtntattaaccgngttacgcgagaagctgactgttcgaacgg

SEQ ID NO: 386676 - DNA, 719 bp, Homo sapiens
  misc_feature: GZ8MTXP01BPM2Z.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtggggagtccctgagtactctcctgtgcagcgtctggatcaccttcagtggctatggcatgcactggcctcccgccagggcctccggggacaagggggctggggagtggggtaggtccctaaatttagtagttgggtaatagggtaacgttaaggggaaaagttaaataaaggacttagtcgggtagggtacccttcccgggtaggaaacgggggtcccgtaactttccgaaccctaacgttacccttacccgaaacggtaacgaaaccaaaccttaaccccgaaaagtaacccgtaacctttccgtttacgttttaccctaacccctaaaagttaccgaaaccgtaacggtcccttagggaacgggaacggggaaccggaacggggaacccgaacggggtaccgttaagggttagtttaacgtttaccgttggttacggtaacgggaacgtaagtaacgttccggaacgtaagttaacggtaaacccggg

SEQ ID NO: 386677 - DNA, 710 bp, Homo sapiens
  misc_feature: GZ8MTXP01D3KEO.22.86.H09.1.454.CMB.2.raw
  modified_base (680)..(680): a, c, t, g, unknown or other
  modified_base (690)..(690): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccgaggcgtccgggacgaaggggctgggaggtgggtgactaattatagtggtatgaagtaggaaagtaaataaagtactaagtggtaggtactccggtaggaacggcgtattcaccatctacaagacgaacaactaccaaagaacacttccttacgtttaccaacctaaagtacaaacgaacgtccgtaaggaaggacggggaccgaacggaaccgacgggacgtagttacgtaagtttacgtggacggtacgaagaagtactacgaactagtacggaaacggttaaacgggtaaacgtttcgggttttacgacgtttacccggtacggggttaccgggggaaccgaaacgggggtacctaaccgggttcggttaccccgtaccgttccgtccgttaaccaaccgttcccgtaacccgaaaccggtacgggtccccttacggttccccgttccccttccccggngcccgtcccncggcctaacggcggtaaccc

SEQ ID NO: 386678 - DNA, 649 bp, Homo sapiens
  misc_feature: GZ8MTXP01E1XTK.22.86.H09.1.454.CMB.2.raw
  modified_base (613)..(613): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggctccgggcaaggggctgggagtgggtgactaattatagtggtatgagtaggaaagtaaataaagactaagtggtaggtaccgtccggtaggaaacgggccgtattcaccatcctaccagaacgacaactccaaagactactctacgtttccacaaatgaacaacgcctggacggaggacggaaggaccgacggactagtgttattacgtggtacgagaagaggatacggaacagacggtaagtaaacggggtaaattcggttttaggacttccgttcggaacgggggacccaaagggtaccgtacgtgggttcccaaccggttccttaccgtctaaccgccctaccaaaccggaacgggtccccttacgttccccggttcccctcccccggnggtcccctcccgtcgttacccgtccggaacggcccg

SEQ ID NO: 386679 - DNA, 647 bp, Homo sapiens
  misc_feature: GZ8MTXP01C1NOJ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccgaggctccgggcgaaggggctgggaggtggggtggactaagttatagtggtatgataggaagtaaataagactatgtaggacgtccgtaggaacggcgattacaccatctaccagacacaactaccaagaactctcttcgttaccacaatagaacaacgcctgagagcgagacgagcagtacgtattactggtgacgaggagtacgtacgaacgtagtacgtaaacggtaacggggtaaacgttcggttttaggaacgttccgtaccggggtacggggaaccccgaagggtacctaccgtacggtcccgtaaccgtcttccttaaccgaccgttcccgtacccgaccgaaaccgggtccccttacggttcccggttcccccttccccggtcggccccgtccccgtgttccccgtaaccggaacggaacccg

SEQ ID NO: 386680 - DNA, 826 bp, Homo sapiens
  misc_feature: GZ8MTXP01BHPM8.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctgggaggtccctgagactctcctgtgcagcgtctggattccaccttcagtggctatggcatgcactggcctccgccaggccgtccggacgaaggggctgggagtgggtgactaaattatatggtatgaattaggaaagtaaataaagactaagtggtaggaacctccggtaggaaacgggcccgtaatttccgaaccctagtacctacccgaagacgaaaccaaactaccgaaacgaactacgttaccttcgttttaccaaccaaaaagttcggaaaacctaaccggtccctaagggaaacgggaacggggacccgggaaacggggtaacccgaagggggtaccgtaagggttacgttaaagtttaaccggtggttaagggaccgggtaagaaaccggtaagttaccgaaccgtaaagttacggaaaccggttaaaaccgggggtaaaagtttcgtttttacggtaaacgttcccgggttaccggtaacggggggaaccccgaaagggggaccctaacggttcggggtaaccctacccggttcttccgttaaccaacccgttccccgtaaaccggaacccgaaacccggggtccccttaacccggttcccggttccccccgtttcccccccggtacgggccccctccccggttcgccccgtaacccggaaccggggaacccg

SEQ ID NO: 386681 - DNA, 658 bp, Homo sapiens
  misc_feature: GZ8MTXP01ELUYI.22.86.H09.1.454.CMB.2.raw
  modified_base (229)..(229): a, c, t, g, unknown or other
  modified_base (616)..(616): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggcgtccgggngaaggggctgggaggtgggtgactaattatagtggtaatgaagtaggaaagtaaataaaaggactaagtaggtggactccggtagaaacggggcctaattcaactactactaccaagacgaacaaacgtaccaaagaactactcgtactttcaacaaatcgaaacaagcctggagaagggcgaaacgggactacgggacagttgtaactttaagtggacgacggaaagacggatacggaactaagtaggaaacgtaacgggtaaattcgtttagaattccgtaggtacggggacgaagggaacacggttggacctaccgttccactccgaacttccccgtaccaccgaaccggtccccacgttcccggttccccgtttaacccccgngggtcccccgtccctcggttaccctaaccggaacggaacccg

SEQ ID NO: 386682 - DNA, 716 bp, Homo sapiens
  misc_feature: GZ8MTXP01ATGUK.22.86.H09.1.454.CMB.2.raw
  modified_base (284)..(284): a, c, t, g, unknown or other
tcagacatacgcgtcacgaccggtgctcgatttagtgctatagacttgagctctggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggaggcgtggtccaggccgtggggacggtccctgacgtactctcctgtgcagtcgtgtggactcaccttnagtggctagtggcatgccacgtcggcctcccggacgacggtccggtcccgggggagtaacgggggtctaggggagggtggggtacgtaacctaaagtttatagttgggtaataacggtaaaggttaaggaaaacgttaaaataaaacggcttaggtcgggtaacgggtaccgtaccggtagggtaacgggtaccggtacgttaccgacctaacgtaccgtaaccgacgaaacgaacaaacctaaccgaaacggaaaccgtaaccttacttacgtttacctaaccctaaacgtaacgaaaccgacgtaccgtaacggtaacggtaagggtacgggaacggaacggaacgggtaccttaagggggggggttaacttaagttacgttggttcggaacggtaggaagtacgtacgacgtaagttaacgtaaacggg

SEQ ID NO: 386683 - DNA, 701 bp, Homo sapiens
  misc_feature: GZ8MTXP01ATCAH.22.86.H09.1.454.CMB.2.raw
  modified_base (266)..(266): a, c, t, g, unknown or other
  modified_base (613)..(613): a, c, t, g, unknown or other
  modified_base (668)..(668): a, c, t, g, unknown or other
  modified_base (679)..(679): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctagtggcatgcacgtggcctccgccgaggccgtccgggacgaaggggctgggaggtgggtgactaattanagtggtatggagtaggaaataaactaaagtactagtggtacggaccgtccggtaggaaacggggccctattccgacctatcctaccagacgaaccaactaccaaagaactctcttacgtttaccactaaaagtcgaaacctaacgtacccgtaaggaagacgggacgacgggaaccgacgggtcgtaagttgttaacttacgtggtacggacggtaaggaacgtacgtacggaactaaggttacgaaaccggttaagggtaaagtttccggttttaggaacgtttccgtacggggtacgggaacccgtaagggacctacgtccgtccgtaccgttcctcgttaaccnccggttcccctaaccgaccggaaccgtcccttacgttcccgttcccttccccggngtccccgtccncgttaccgtccgaagggtcccc

SEQ ID NO: 386684 - DNA, 776 bp, Homo sapiens
  misc_feature: GZ8MTXP01EXNVT.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattccaccttcagtggctagtggcagtgccacgtcgggcctccgccgaggccgtccgggagaagggggctggggacggtggggtagactaattagtagtggtataggtaagtaggaaagtaaataaagtacgtaagtggtacggtaccgtcggtaggaacgggtccgtaattaccacgtactcctaccgagaccgaaactaaaccgtacgaaacgactacttcttacgttaccacgaaagtcgaaacacgtcgtaaggagggacgggacgacgggtaaccgacgggtactaacggttgttaaacgttcgtgggtacgacggtaagtaacgtacggttacgaaccgtaagttacgggaaaaccgggttaaacggggttacgttaccggttttagtaacggttccgtacgggggtccggggaaaccgtacggggttaacaccgggtttcgtacccgtttaaccggtttccgtttaccgaaccgttccccgttaccggaaaccgttacccgggtcccgttacggttcccggttcccccgtttcccgcgggttcccgtaaccctcggtacccgttaccggaacgggttaaccgtaaccccgg

SEQ ID NO: 386685 - DNA, 571 bp, Homo sapiens
  misc_feature: GZ8MTXP01AHM6Q.22.86.H09.1.454.CMB.2.raw
  modified_base (341)..(341): a, c, t, g, unknown or other
  modified_base (390)..(390): a, c, t, g, unknown or other
  modified_base (394)..(394): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaagggggctgggagtggggtggacaatttatatggtatgatagtaaagtaataaagactatggtggactccggtgaaagggccattcaccatcctccagacacaactaccaanaactctctcgtttcacaaatcgaacagctggagagggcgagacacgggnagtntattactcgtgacgagagatacggacagtacgtaacgtacggggtaaatccggtttagaacgttcgtacgtcggggacctaagggacctacgtcggtcaccgttcctcctcacgcctacccgacgaaccggccttacgttccgttcctccccgcgcccgccctgccctcgaagcccg

SEQ ID NO: 386686 - DNA, 611 bp, Homo sapiens
  misc_feature: GZ8MTXP01AL3Z2.22.86.H09.1.454.CMB.2.raw
  modified_base (542)..(542): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggctaattatatggtatgataggaaagtaaataaagactaatgtggactcggtagaaggccgattcaccatctccagagacaactaccaaagaacactcttaccttctaccaaatcgaacaacgcctaaggagagggacggacggacgacggtctagtgtattactgtcgcgagacgatcgaacagttacgaacgtaacgggtaaacgtcgttttagacgttcgtcggtcggggaccaagggtactacgtcggtccaccgttctcctcgacgttccctaccaccgaaccgggtcccncgttcccgggttcccctttcccccgtggggccccgtccccttcgggttccctaacccggcggtccccgg

SEQ ID NO: 386687 - DNA, 731 bp, Homo sapiens
  misc_feature: GZ8MTXP01D45QI.22.86.H09.1.454.CMB.2.raw
  modified_base (252)..(252): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagccgtgggagtcctgagctctcctgtcgnagcgtctaggactcaccttcagtgctatggcatgcactggcctccgcgaggcgtcccgggagaagggggctaggaggtggggtggacctaattagtagtaggtataggaattaagggaaaagttaaacgtaaaagggtacttaagtgggtacgggtaacccgttcccgggtaggaaacgggggtccctaatttacccgaaaccgttaacgttacccttaacccggaaagaacggtaaaaccccgaaacgtttaaacccaaacggtaaacccgtaacccttttacctttaacggttttaccctaaacccaaaagttaccgaaacgaaacggtccccgttagggaaacgggtacgggaccgggaaagggtaacccgaacggggtacccttaacgggttaggttaaccgttttaacgttgggttacccggcggtaacggaagttaacgtacgggaacctaaggttaacggtaaaacccgggg

SEQ ID NO: 386688 - DNA, 738 bp, Homo sapiens
  misc_feature: GZ8MTXP01EH3MS.22.86.H09.1.454.CMB.2.raw
  modified_base (301)..(301): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcgttttaagaggtgtccagtgtcaggtgcagctgggtggagtcgtgggggatcgtggtccagccgtggggacgtccctgagactctccgtgtgcagcgtcgtggtattcaccttnaggtggctagtggactagtcgcctagtcgggcctcccgacgacgggtccgtccggggacgaagggggtcgtgggagggtgggtagactaaagtttaagtaagttgggttaatagggtaagttaaacggggaaaagttaaagtaaaagcgttaagttcggtacgggtaccgtaccgggtagggaaacggggtacccttaagtttaacccaacccgtattaccccgtaaccgaaagggaacctaaaccctaaaacgttaccccgaaaaaagtaaccctaccgtttaccttacggttttaaccctaaaccgtaaaattacgggaaaccacggttcccgtaaagggaacggttacgggaaccggaaaggaacccggaaccgggttagttaaccgttacgttaaattcggttaagtaggacggaaggaagttaacgtaaccg

SEQ ID NO: 386689 - DNA, 772 bp, Homo sapiens
  misc_feature: GZ8MTXP01CT5EA.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcgagtggctagtggcagtgcacgtggcctccgccgacgggccgtccggggacgaagggggcgtggggaggtggggtgactaattagtagtggtatgataggaaagtaaactaaagatagtgtggacgtcggtagaacggcgtatacacatctacaagacaacaactacaaacgactacttcttaccgttacctaaacaaatacgaaacaacgaccgtaaggaacggaacgggacggaacgggaaccgacgggacgtaagggttactttaagtaacggttggaggaccggaaaaggtacgtaacgttaccgggaaaccttaaggaaacggtaaacccgggttaaaacgggggttaaaacgtttcgggtttttaaacgacggtttaccgtaccggggttacgggggaaaccccgtaaaaggggtccgtaaaccggttccggttaacccggaacccctttcgtttacccgtaaccgaacccggttacccctaccccggaaaccggtaacccgggtccccttaccgttcccggttaccccgttcccccgggtgccccgtaccccgtcggacgtcccggaacggtcccg

SEQ ID NO: 386690 - DNA, 656 bp, Homo sapiens
  misc_feature: GZ8MTXP01D52ZQ.22.86.H09.1.454.CMB.2.raw
  modified_base (224)..(224): a, c, t, g, unknown or other
  modified_base (237)..(238): a, c, t, g, unknown or other
  modified_base (258)..(258): a, c, t, g, unknown or other
  modified_base (377)..(377): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgatgttggtgttatactntgtctctgtacanncaccagcaacgccccagacncatctatttatgctgtacaagtaacggccggtccctcggacggggtccctgtactcgtctttctcgtaggcctaccaagtctacggacctaaacgaccggtcccctcccgaacgacctntccgtcgtcgggacctcccgagggtctagaagtagtacggtagggtcttagtaatttacgttactggtcttgtaccttacgtagtttcgacggtcggtccgtacctaacgtcggttcggggtcggttcgggacgggacggaaccgtaacgtccgtcggtaacccggtacgttacggtaccgaaccggaccccggtaaaccggttccgttccccggttcccccgtggttacccctaaccgtttccccgtccgttacccccctcccgttaacccgtcccgg

SEQ ID NO: 386691 - DNA, 634 bp, Homo sapiens
  misc_feature: GZ8MTXP01C7A8S.22.86.H09.1.454.CMB.2.raw
  modified_base (216)..(216): a, c, t, g, unknown or other
  modified_base (513)..(513): a, c, t, g, unknown or other
tcagacatacgcgtcacgaccggtgctcgatttagtgctatagacttggggtttgggggggaagaggaagactgacggtcctgccacaggtggtgctgggcacggtgggcactcgacacaacatttgcgctcaactgtcttgtctcaccatggagtttgggctgagtcttgggttttcctcgttgcttctttttaagaggtgtccagtgtcaggtncagcgtgggtggagtcggtgggggagtcggtggtccagccgtggggacgtccctagacgtctcgtctgtgcagcgtgtgtacttccaccttcagtggctagtggctagtcgctacgtcggcctcccgccgacgggtccggtccgggaggaggggtcgtgggaggtgggtagactaaagttatagtggtataggtaagtaacggtaaagtaaagtaaagacgttagtaggtacggtacgtacggtaaggaaccgggctacgttcaacttcactacgaagaacaactaacaaccgaaanacctacttcgttactttacaaactaatcgaacacgtcgaaggacgggacggacggaacggtacaccgggattggttaacgttaacttcggtgtaggacggagtaacggttaactaaccggg

SEQ ID NO: 386692 - DNA, 602 bp, Homo sapiens
  misc_feature: GZ8MTXP01EWX89.22.86.H09.1.454.CMB.2.raw
  modified_base (266)..(266): a, c, t, g, unknown or other
  modified_base (277)..(277): a, c, t, g, unknown or other
  modified_base (286)..(286): a, c, t, g, unknown or other
  modified_base (295)..(295): a, c, t, g, unknown or other
  modified_base (318)..(318): a, c, t, g, unknown or other
  modified_base (395)..(395): a, c, t, g, unknown or other
tcagacatacgcgtcacgaccggtgctcgatttagtgctatagacttgggtttgggggggagaggagcccagcactagaagtcggcggtgtttccattcggtgatcagcactgaacacagaggactcaccatggagtttggctgagcttgggttttcctcgttgcttcttttaaagaggtgtccagtgtcaggtgcagctgggtggagtcgtgggggagcgtggtccagccgtgggacgtccctgagactctccgtgtgcagcgtntgatcaccttnagtgctagngcatcgcanggcctccgcgaggccgtccgggngaagggggctaggggaggtcggtgactaaagtttataagtggtaatagtaagtaggaaaaaaagttaaactaaaggnttagtgtacgtacgtcgggagaacgggctattcacatctacaagacgaacaaacctacaaacgaactacttcttacgggtttaccaacgtaaaatcgaaacacgtccgaggaaacgggcggacgaaggacgtaaggctaagttagtattagtggtagacggagacgtaagacgaacgtagacggttaaacgttaacggttaacgttg

SEQ ID NO: 386693 - DNA, 646 bp, Homo sapiens
  misc_feature: GZ8MTXP01AIBWG.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagctggtggagtcgtgggggagcgtggtccagccgtgggagtccctgagactctcctgtgcagcgtctggattccaccttcagtggctagtggcagtgcacgtgctccgcaggctcgggcaaggggctggaggtgggtgactaattaagagtggtatggaatagggtaaagtaataaagtactagttggtacggtaacgtccggtagggaaacggggtacccgtacgttaccaaccctatcccgtaaccgaagtaccgaacgaaacccgtaccaaacgaaacctaccttcgttacgttacctaaacccaaagttacgaaacacggtcctaaggaacgacggggacgaacgggaaacgaaccgggcgttaacggttacggttaaaattcggttaacggttagaccgggttacggaaggttaacgttaacccgg

SEQ ID NO: 386694 - DNA, 777 bp, Homo sapiens
  misc_feature: GZ8MTXP01B8LLE.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggacggtccctgagactctcctgtgcagcgtctggattcaccttcagtggctagtggcatgcactcggcctcccgccaggccgtccgggcgaaggggctgggaggtggggtgactaattatagtggtatgatagggaaagtaaataaagactagtggtggacctccggtaggaacgggccgtattccaccagttctccgagacgaacaactccaaagaacacttcttgtttaccacaaagtcgaaactacgccctggaacggacgggacggacgggaaccgacggggcaaggttcgttaattacgtggtgacggagaacggtacgacgaacgaagtacggtaacgtaaacgggggtaaacgtttccgtttttaggaacgtttccgtttaccgggacgggggtaaccccggtaaacgggaccgtacccggttcgggttaaccccgtacccggtttaccctttcgtttaaccccgaacccggttaccccgttaacccccgaaacccgggtaaaaccccggggtcccccgttaacggttttcccccggggttaccccctttttccccccccggggcgggtcccccgttacccccgttccggacccgtttaaccccggaaaccggggtaacccccg

SEQ ID NO: 386695 - DNA, 713 bp, Homo sapiens
  misc_feature: GZ8MTXP01D7UT0.22.86.H09.1.454.CMB.2.raw
  modified_base (257)..(257): a, c, t, g, unknown or other
  modified_base (668)..(668): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcgagtgctagtggcatgcacgtggcctccgccgaggccgtccgggacgaaggggctagggaggtgggngactaattagagtggtatgaagtaggaaagtaaataaagtactaagtggtacggtaccgtcggaggacggcctaattccactatcacagacgaacaacctacaaacgactacttcgttacgttacctaacaaagtcgaacaacggtaccaaggaggtacgggacgacggacgtacgggactagttacgttattacggtcgggagacggaaggtaacgacgttacgaacgtacggtaacgaaacgggtttaaacgggtaagtttcggttttacgaacgttccgggttaacgggaggggtaaccccggaaaggtcctacgggtcggtcctaccgttcctcgttaacccacgttaccccgtaaccggaaaccgtaaccggtcccttcggttccccggttccccttcccccgggnggccccgtcccgtcgttacccgtaaccgttaacgggtaacccccg

SEQ ID NO: 386696 - DNA, 759 bp, Homo sapiens
  misc_feature: GZ8MTXP01EV31O.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgccgaggccgtccggggacgaagggggctgggaggtgggtggactaattatagtggtatggagtaggaaagtaaataaagtactaagtggtacggtaccgtaccggtaggaaacgggcccgtaatttccaacccattccctaccgaagaacgaacctaaacctacccaaagaacctaccttactttacgtttacctaacaaaatacgaaacaacgaccgtggaggagggcgaggacgacgggctaagtgttaattacgtggtagacgagaagacgtacgactaagtacgtaacggtaacgggtaaagttcggttttagacgttcgtaccgggtacgggggaacccgtaaacggggtacctaccggttcggtcccgttaaccccggttccgtttcccttcccgtaacccgttacccccttaaccccggaaaccccgtaaacccgggggtcccccttaacgggtttcccccgggtttacccccgtttccccccgcgggtccccgtcccccgtacgttccccgtaacccggaacggggtaaccccg

SEQ ID NO: 386697 - DNA, 700 bp, Homo sapiens
  misc_feature: GZ8MTXP01DFYD2.22.86.H09.1.454.CMB.2.raw
  modified_base (270)..(270): a, c, t, g, unknown or other
  modified_base (281)..(281): a, c, t, g, unknown or other
  modified_base (330)..(330): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgattggttggtgttaataactatgtctcgtgtaccaacagccaccaggacaaacgccccagacncatctatttangctgtacaatacggccgtccctcggacggggtccctgactcgtctttcncgtggcctcagtctcggaccaaacgccggtccctcccgtacgaacctctcctcgtcggggtcctaccgagggtcgtaggaagtcgttaggacggtcttagttaactttaagttcgtgtctcgttactcgtagtttcgacggtacggtcccgttaccgtacggttacggtttcgggggtcggttaccgggggaccggggtaacgggtaccgtaaacgggtccgtaacccgggtaaccccggttccgttaacggggttacccaccggggtaaaccccgtacgggttccccgttcccggttccccccgttaacgggttcccttaacccggttcccgttccccgggttaaccccctccccgttccgtaacccgg

SEQ ID NO: 386698 - DNA, 684 bp, Homo sapiens
  misc_feature: GZ8MTXP01BE0X0.22.86.H09.1.454.CMB.2.raw
  modified_base (465)..(465): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcgagtggctagtggcatgcacgtggcctccgccgaggccgtccgggacgaaggggctgggaggtgggtgactaattagtagtggtatagagtaggaaataaataagactaagtggtcgacgtcggtagaacgggctacttacactactacgtacgaaggaacaaccaacgtaaccaaacgtaactaccttactttaccgttaccaaacgtaaagtccgaaactaacgacctgggaaacgacgggacgaacgtacgacggatagtacttagttaaggnggagacgaagtaacgactacgaacgtaggtaacgtaaacggttaacggttatttcggttaggtacgttccggaacgggtaaccgggaacgaacggtccgtaccggtcgtaaccctccgttactccgaaccgtaaccgccccgtaaaccgaaccggtaccgtcccttcccggttcccgttccccgtccggccgccctccgtacggccgaaccgaacgccg

SEQ ID NO: 386699 - DNA, 725 bp, Homo sapiens
  misc_feature: GZ8MTXP01CL0R2.22.86.H09.1.454.CMB.2.raw
  modified_base (316)..(316): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcctgggacgtccctgagactctcctgtgcagcgtctggatcaccttcagtggctatggcatgcactggcctccgcgaggccgtccgggganaacgggggctgggagtggggtgacctaattagtagtggtatagaagtaagggaaattaaacgtaaaaggtactagttagggtaggaaccgttcccggtaggaaacggggtcccgtaagtttaccaacctaacttcccgtaccaacgggaacgaaaccctaaaccgtacccgaaaacgtaaaccgtacctttaccgtttacgtttaacccttaacccaaaaagttaccggaaaaccaacgggtccccgttaaagggaagggtaaacggggccggaaacggggtaacccgaacggggggttaacccttaaaggggtttaaccggtttaactttaaccggttcgggttagggtaacccggaaagggaaggtacgtaccggaacgtaaggttaacgggttaaaaacccggggg

SEQ ID NO: 386700 - DNA, 596 bp, Homo sapiens
  misc_feature: GZ8MTXP01BYRKM.22.86.H09.1.454.CMB.2.raw
  modified_base (346)..(346): a, c, t, g, unknown or other
  modified_base (366)..(366): a, c, t, g, unknown or other
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggcgtccgggacaaggggctgggagtggggtgctaattatagtggtatgaatggaaataaataaagactagtggtggaccgtccggtaggaagggcccgattcaccatctccagacacaactccaaanacactctcgttctacaaatnaacagcctgagaggcgaggcacggcagtntattcgtgtgcgagagtactcgaacagtacgtaacgaacgggtaaacgttcgtttagacgtcgtacggtcggggacgagggtactacgtcggtacctaccgtcttcttcacgttccgtacccgaccgtaacgggcccttacgttcccggttccccttccccggtccggccgtccccgtcgcccgtccgaacgggtaacccg

SEQ ID NO: 386701 - DNA, 672 bp, Homo sapiens
  misc_feature: GZ8MTXP01C8IC5.22.86.H09.1.454.CMB.2.raw
  modified_base (359)..(359): a, c, t, g, unknown or other
  modified_base (569)..(569): a, c, t, g, unknown or other
tcagacatacgcgtcacgaccggtgctcgatttagtgctatagacttgggtttgggctgagctgggttttcctcgttgctctttttaagaggtgtccagtgtcaggtgcagctggtggagtctgggggaggcgtggtccagcctgggaggtccctgagactctcctgtgcagcgtctggattccaccttcagtggctatggcatgcactggctccgcaggctccgggcaaggggctgggaggtgggtggactaattatagtggtatgaataggaaagtaaataaaggactaatggtggacctccggtaggaaacgggccgtattcaccctatctaccgagacgacaacgtacaaagacnctacttcgtttaccacaaatcgaacaacgccgtggaggacgggacgaacggacgacgggtacgtagttagttattacgtggtaggacgaagaagacttacggaactagtaacgaccgttaaagggtaaacgttcggttttacgtacgttacgtcggtacgggggaaccgaacggggactacggttcggtcctaccggttctccgttaacncgttacccctaccgacccggaaccgggtccccttacggttccccggttacccgttccccccggtggtccccgtcccgttcgcccgttccgaacggggtccccc

SEQ ID NO: 386702 - DNA, 784 bp, Homo sapiens
  misc_feature: GZ8MTXP01AIK84.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccaggcctgggaggtccctgagactctcctgtgcagcgtctggattccaccttcagtggctagtggcatgcacgtggcctccggccgaggccgtccggggacgaagggggtcgtgggagggtggggtggactaattagtagtggtatgagtaggaaataaataaagtactagtgtggactccggtaggaacgggtcctatcacctactctaccgaagacgaaccaactaccaaagaaactaccgttctttaccgtttacctaccaaaagttacgaaacgtaacggcccgtaaggaaacgggaaccggggacgggaaacggggaaccgtaaccgggtacgtaggttacgtttaagttacgtgggttacggacgaaggacgtagtaccgtaacaaggttaacgggtaaacgttacggggttaaaagttccggtttttaggaacgtttccggtacgggttaccgggggaacccggtaaacgggtaccgtaaccggttcggtaccctaaccccggttcttccttaaccgccgttaccccgtacccgaacccggtaaccgggtccccttaaccgggtttccccgttcccccggtttcccccgttcgggccccgttcccgtccggttacccctaaccgaaccgggtaaccccg

SEQ ID NO: 386703 - DNA, 662 bp, Homo sapiens
  misc_feature: GZ8MTXP01BRGUH.22.86.H09.1.454.CMB.2.raw
  modified_base (375)..(375): a, c, t, g, unknown or other
  modified_base (472)..(472): a, c, t, g, unknown or other
  modified_base (626)..(626): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgccactcggcctccgccgacggccgtccgggacgaaggggcgtgggaggtggggtggactaagttatagtaggtatggaagtaggaaagtaaataaagtactaagtggtggactaccggtaggaaacgggcctatcaccatcctacagacgaccaacgtaccaaagaaccncttcttcgttacacaaatacgaacaacgcctggagacgggacgaacggacgacgggactagttagtattacgtgtaggacgaagaagtactacgaanaacgttacggacgtaaacggggtaagttcgttttagagttccgtacggtacgggaaccgtagggacttacgtcggtacctaacgttcctacgtaacaccgttcccaacccgaccgaaccggtccccttacgttccccggttacccgtcccccgnggtcccgtcccgtagcccgtaacgaacggtaacccg

SEQ ID NO: 386704 - DNA, 690 bp, Homo sapiens
  misc_feature: GZ8MTXP01DNW5S.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggcctccgccaggcgtccggcgaagggggctgggaggtggggtgactaattatagtggtatgataggaaataaataaagactagtgtgactcgtaggaaggcatcacatctcagagaacaactacaaagaactacgtcttcgtttaccactaaagtcgaaacaacgacgtggaaaggacgggaacggaacggaaccacgggactaaggttacgttaatttacgtggtcggacgaagaaggtactacggaactagttacgaaacgttaacggggtaaatttcggttttaacgaacgttcgtaccgggtaggggacccgaaaggggaccctaacggttcggtaccgtaccggttcctccgttaaccaccggttaccctaccccgaacggaaacccgggtccccttaacgggtttccccgttaccccgttccccccggtgggccccttccccgtcggaccccgtaacggaaccgggtaaccccgg

SEQ ID NO: 386705 - DNA, 791 bp, Homo sapiens
  misc_feature: GZ8MTXP01B5O7G.22.86.H09.1.454.CMB.2.raw
  modified_base (374)..(374): a, c, t, g, unknown or other
  modified_base (461)..(461): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctagtggcatgccacgtcggcctcccgccgacggccgtccggggacgaaggggcgtgggaggttggggtgactaaattagtagtggtataggaagtaggaaagtaaataaagactagtggtacggacgtccggtaggaacgggcctatccacctactctaccagacaaccaactacaanaacactcttcttaccaacaaagtcgaacgtaacgccgtaaggaaggacggacggaacggacgacgggtcgaagttagtacgttacgngggtacgacggtaagaacgtacgtaccgaacaagttacgggaaacggtttaaacggggtaactttcggttttacggaacgtttcccgggtacggggttaccgggggaacccgtaaaacgggggtccctaaacggtttcccggtaacccgttaccccggtttacctttcccggttaaccccgtaaccggttcccccctaaacccgggttaaaccccggtaacccgggttcccccgttaaccgtttccccccggggtttcccccgtttaaccccccgggcgggtccccccgttcccgtcggttacccccgttaaccgaaacccgggggcccc

SEQ ID NO: 386706 - DNA, 599 bp, Homo sapiens
  misc_feature: GZ8MTXP01DTFPO.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtggggtggcaattatatggtatgatggaaagtaaataaagactaatgtggactccgtgaaagggccgattcaccatctccagagacaactccaaagaacactctcgtttctcaaatcgaacaagcctgagaggcgagacacggcagtgtattactgtgcgagagatcgacatgaactaacggggaaaagcgtttttaggaattccgtacgtcgggggacccaaagggggactaaccgtgggtaccacccgttctcctttaacacgccctacccaacccgaaaacggggcccccttaaagttcccgggttccccttccccccgtcgggcccggcccccttggccttcccgaagggaaccg

SEQ ID NO: 386707 - DNA, 729 bp, Homo sapiens
  misc_feature: GZ8MTXP01AXL1C.22.86.H09.1.454.CMB.2.raw
  modified_base (271)..(271): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcactcggcctccgccaggccgtccgggacgaagggggctgggaggttggggtagactaaagtttanagttaggtatgaatagggaaagttaaataaagtactagtggtacggacctccggtaggaaaggccccgtatttccacattctaccagtaacgaacaacctacgaaagaactacttcttacgtttaccacgaaaatcggaaacacgaccctggaacggacgggtcggaacggacgacggatagttagtattacgtggagacgagaagacgttaccgaagagtacgtaaccgtaaaggggtaaacttcggttttacgaagttccgtacgggtaccggggaaccgaaaggggtacccacggtttacggtacccgtaaccggtttccgttaccctttaacgaaccggttacccctacccggaaccggtaaacccggggcccttaaccgggttcccggttaccccgtcccccggttgggcccctccccggttcgttaacccgtcccgaaccggggtaaccccg

SEQ ID NO: 386708 - DNA, 647 bp, Homo sapiens
  misc_feature: GZ8MTXP01CXAVQ.22.86.H09.1.454.CMB.2.raw
  modified_base (195)..(195): a, c, t, g, unknown or other
  modified_base (591)..(591): a, c, t, g, unknown or other
  modified_base (628)..(628): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagnggtgtccagtgtcgaggtgcagcgtggtggagtcgtgggggagcgtggtccagccgtggggacgtccctggacgactcgtccgtgtcgcaggcgccgtggtacttccaccttcgagtggctagtggctagtcgctacgtcggcctcccgccgacgggccgtccgggacggaagggggtccgtggggaggttggggcggtactaaagtttaatagtggttagtaggaaaggtaaggaaaagtaaacgtaaagtacttagtcgggtaggaccgttcgggtaggaacggggtcctaacttccaactatccgtacaagtacaaacgaacctaccgaaagtaacctcgttacttcgttacctaaaccaaatacgaaacctacgccgtaaggaacgacgggngaaacgggacacggacgttagttgttaatcgtaaggngaggagtcgaagtaaccgg

SEQ ID NO: 386709 - DNA, 730 bp, Homo sapiens
  misc_feature: GZ8MTXP01EIQIN.22.86.H09.1.454.CMB.2.raw
  modified_base (261)..(261): a, c, t, g, unknown or other
  modified_base (464)..(464): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagacttctcctgtgcagcgtctggattcaccttcagtggctatggcatgcactggcctccgccaggcgtccgggcgaaggggctgggaggtgggagtacaattanagtggtatgaagtaggaaagtaataaagactagtgtacgacgtcgtaggaacggccgtatccacctatactaccaagtaacgaaccaacgtacaaacgtaacctacttctttaccgtttacctaacgaaatacgaaacgaacgtaccgtggaaggacgggaccggaaggaccgacgggtacgtagttacgttattacgtaggngaacggaagtaagccgttaacgacctaagtaacggtaacggtaaacgggttaaacgtttcgggttttacgacggttaccgttccggggtaacgggggaacccgaaacggggtacgtaacccggttaggtccccgttaaccccgtctttcctaaccggtaccgcccttaaacccgaccgaaacccgggtcccttccggttccccgggttacccctccccggtcggtccccgtccgtccggttaccgtaaccgttaacggggaacccc

SEQ ID NO: 386710 - DNA, 751 bp, Homo sapiens
  misc_feature: GZ8MTXP01EV0H2.22.86.H09.1.454.CMB.2.raw
  modified_base (232)..(232): a, c, t, g, unknown or other
  modified_base (719)..(719): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgccactggcctccgccaggcgtccgggngaaggggctgggaggtgggtgactaattatagtggtatgaagtagggaaagtaaataaagactagtggtacggtacgtccggtaaggaaacgggtcctaatttcccgaacctagtacctaccgaagacgaacctaacgtacaaacgaaactacttcttacgtttacccaacaaagtacaacccgtaagaccgtaagggaacggacggggaccgaaggggaaccccaggggacttaagggtttagttaacgtttaccggtaggagtacggtaaaggaagtacttaccggaattaacgaacggtaaacggttaaaccggggtaaattttcggtttttacggaacgtttccgtacggggttacggggaaacccgtaaacgggtacgtaccgggttacgtacccgttacccgttcttcccgtaacaacccggttccccaacccgaaccggtaaccgggtccccttacggttccccggttccccttccccgnggccctaccccgtgcctaacggaacggaaccg

SEQ ID NO: 386711 - DNA, 796 bp, Homo sapiens
  misc_feature: GZ8MTXP01AB79E.22.86.H09.1.454.CMB.2.raw
  modified_base (187)..(187): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttnagtgctatggcatgcactggcctccgccaggctccggggacaagggggctgggaggtggggtgactaaattatagtggtatgataggaaagtaaataaagactagtggtaggaccgtccggtaggaacgggtcccgtaagtttccaaccgtatacctacccgaaggaacgaaccaaacctaccgaaaacgtaacctacgttcctttaccggttttacctaacctaaaacgttacgaaaccgaaccgtacccgttaaggaacgggaacgggggtacgaaacggggaaccgaaccgggtacgttaagggttacgtttaaacgtttaccggtagggttacgggaaccggaaaggtaacggtaacgttaccggaaaccgttaaggtaacggttaaacggtaaacggggttaaacgttccggttttttaaggaccgtttcggtacccgggtacgggggaacccgtaaagggtaccctaaacggttcggtacctacccggttcttccgtaacaccgttacccgtacccaacggaaccgggtcccttacggttcccggttaccccttcccccggtacggcccgtaccccgtcgttacctcccgaacgggtaacccg

SEQ ID NO: 386712 - DNA, 560 bp, Homo sapiens
  misc_feature: GZ8MTXP01AQ7O1.22.86.H09.1.454.CMB.2.raw
  modified_base (226)..(226): a, c, t, g, unknown or other
  modified_base (326)..(326): a, c, t, g, unknown or other
  modified_base (342)..(342): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactgctccgcaggctccgggnaaggggctggagtgggtgcaattatatgtatgatggaaagtaataaagactatgtgactccgtgaaggccattcacatctccagagacaactcaagaacnctctcgttacacaatnaacagcctgagagcgaggactacgggcacgtgtacttacgagtggacgagaagagtacgactagtagaaacttacgggggaaatcggttttagattcgtcgtaggggaccgtaaacggacagtcggtcaaccgttctctcaccgctaccgacgtaccggcccttcgttaccgttccccgttaaccccgcgcccgtccctgccctcgaagggtaacccg

SEQ ID NO: 386713 - DNA, 688 bp, Homo sapiens
  misc_feature: GZ8MTXP01BM4Y9.22.86.H09.1.454.CMB.2.raw
  modified_base (189)..(189): a, c, t, g, unknown or other
  modified_base (258)..(258): a, c, t, g, unknown or other
  modified_base (653)..(653): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggcctccgccaggctccgggcgaaggggctgggagtgggtgactaattanagtggtatgataggaaataataaagactagtggtaggactccggtagaaagggccgtattcacctatctaccaggactaacaactaccaaagaaactcttacttcgtttacctaaccaaaagttacgaaaccgtaacgacccgtaagggaacgaacggggacggaaacggaccggtaacgggacttaaaggttcgtttaagttaccggttaggtacggacggaaaggaacgtacgttacggaactaagtacgtaacggttaaacgggtaaacgtttcgtttaggtacgtccgtacgggtaggggacccaaagggactaaccgtgtacccgtacgtccttcgtaaccacgcccgtacccgacgaacggtcccacgttcccggttcccttccccggnggccctcccgtcgttacccgtaaccgcggaacccg

SEQ ID NO: 386714 - DNA, 716 bp, Homo sapiens
  misc_feature: GZ8MTXP01BE11L.22.86.H09.1.454.CMB.2.raw
  modified_base (356)..(356): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtgctatggcatgcctacgtcggcctcccgccgacggccgtcccggggacgaagggggcgtagggtacgggtggggtcggtactaaatttagtagtaggtagtagaagtaaggaaagtaaagtaaacgtatagtgtcggaccgtcgaggaacggctattaccactntctcagacgaacaacaccaagtaactacttcttacgttaccaacaaagtcgaacaaacgtcccgtggaaggacgggaccgaacgggaccacgggtacgtaagttacgttaattacgaggtcgagtagaacgacgttacgaactaggtaacgaaccgttaaagggttacgttcggtttacgaacgtttcgaccgggtaggggaaacccgtacggaagttccggttccgtaccgttaccgttccgttacccttaaccgacccgttacccgaaacccgacccgggtaaacccgtcccgttaccgtttccccggttccccgtttccccgcgggcccctaccggtccaccgtccggcgaacccgg

SEQ ID NO: 386715 - DNA, 609 bp, Homo sapiens
  misc_feature: GZ8MTXP01CE6PD.22.86.H09.1.454.CMB.2.raw
  modified_base (336)..(336): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaaggggctgggagtgggtgctaattatagtggtatgatggaaagtaataagactatgtggactccgagaaggccgattcacctatctaccagacgacaactccaagaacnctcttcgtttcacaatcgaacagccctgacgagcgagacacgcagtgtatacgtgtgacgagagatacgacagtacgacgtaacgggaagttcgtttgacttcgacggttcggggaaccaaggggacctacgtcgggtacctacccggttcttcccttaacgccgttcccgaacccacccggtaaacggggtcccccttaacgggttccccggttccccttaacccccggtcggccccgtaccccgttcttacccgtcccgaaggtaaccccg

SEQ ID NO: 386716 - DNA, 670 bp, Homo sapiens
  misc_feature: GZ8MTXP01BKPCR.22.86.H09.1.454.CMB.2.raw
  modified_base (245)..(245): a, c, t, g, unknown or other
  modified_base (259)..(259): a, c, t, g, unknown or other
  modified_base (270)..(270): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggagtccctgagacctntcctgtgcagcgtntggatcacttnagtggctatggcatgcactggcctccgccagggctcccgggggacaaaggggggctaggggagtggggtaggctaaaagtttagtagttaggtataagagttaagggaaaagtttaaaataaaaggaccttaagttgggttggggaaccttccggtaggaaacggggccgtaatttccaaccaattccctcccgaaagggaacgtaaaccaaactaccaaaaacaaaccgtaacttcggttaccttttacctaaacccaaaaaacgggttacgaaacgaacgaccgtacggtaacggaacgggacggaacgggaacggaacggaacgttagttagttaacgtttacgttggttacggaacggaaggaacgaacgtacgaacgtaacgttaacggtaacgg

SEQ ID NO: 386717 - DNA, 645 bp, Homo sapiens
  misc_feature: GZ8MTXP01EWK2R.22.86.H09.1.454.CMB.2.raw
  modified_base (173)..(173): a, c, t, g, unknown or other
  modified_base (273)..(273): a, c, t, g, unknown or other
  modified_base (323)..(323): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagnggtgtccagtgtcaggtgcagctggtggagtcgtgggggagcgtggtccaggcctggggaggtccctgagactctcctgtgcagcgtctggatcaccttnagtggctagtggcagtgctacgtggcctccgaccgaggcgtccccggggngaacgggggcttggggacggtggggtagacctaaagtttagtagtggtataggaattaaggggaaataaagtaaagacttagtgggtacggaccgtccggtaggtaagggtcgattccactacgtctaccaaggacaaccaactaccgaaagtaacctacttacttacgtttacctaacctaaagttcggaaacacggtacccgtaggacggagggccggtaacgggaacgacgggtaccgttacggttagttaacgtttaccgttggttcggaaccgaaggaacggtactacgggaacctaagttaacgggtaaaaccggg

SEQ ID NO: 386718 - DNA, 680 bp, Homo sapiens
  misc_feature: GZ8MTXP01AY3CA.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgcaggcgtccgggcaaggggctgggagtggggtgcaattatatggtatgataggaaataataaagactatggtagacgtccgtaggaacggccgtattccaccatcctaccgagacgaccaacgtaccaaagaactctcttacgttaccacaaatcgaacaagtacctgaaggacggacgacggaccgacggtacagttagtattaccggtggtggacggagaacgagtacgaacagtacgaacggtaacgggtaaacgttcgtttttacggaacgtttccgtccggggttacgggggaaccccgaaagggtaccgtaaccgggttcggtacccgtaacccggttccttccgttaaccgaccgttcccctaccccgaaccggaaacccgggtccccttacggttccccggttccccgttcccccggtcggtccccgtcccgttcggcccctccggaacgggtccccg

SEQ ID NO: 386719 - DNA, 743 bp, Homo sapiens
  misc_feature: GZ8MTXP01EWZRE.22.86.H09.1.454.CMB.2.raw
  modified_base (211)..(211): a, c, t, g, unknown or other
  modified_base (494)..(494): a, c, t, g, unknown or other
  modified_base (555)..(555): a, c, t, g, unknown or other
tcagacatacgcgtcacgaccggtgctcgatttagtgctatagacttgggtttgggctgagctgggttttcctcgttgctcttttaagaggtgtccagtgtcaggcgcagctggtggagtctgggggaggcgtcggtccagcctgggaggtccctgagactctcctgtgcagcgtctggattcaccttcagtggcctatggactactcgcncgtcgccgcccggtaccgggccgtaccggggccgacggggacggtgggtaggtgggtagggtcgtaattaagttaataggtaagtaggtaagtaaggtaaaggtaaagtaaagtaacgtaagtacgttacggtacggtaccggtccggtaacgggtaccggaccgtactcaaccccgtacgtacctacccgaacgacgaaacaaacctaccctaaacgtaacccctaacctacttagtttacctaccaaaatacgaacgacgaccgtacgacgctacggacgnaacggtacgacgtacgtagtagtacgtacgcttacgtacgacgagtacgacgtacgacgtntacgtacggtaacgttacgtttacggtacgtacggtacgtacgggtacggtaacgggtaaccgtaacgttcggttacccgtaccggttcccgttacccgttcaaccggaccccgttaccccgtaaccccgccgtaacccggtaccccttacccggttcccgggttcccccgttccccccggttccggg

SEQ ID NO: 386720 - DNA, 637 bp, Homo sapiens
  misc_feature: GZ8MTXP01DPG2U.22.86.H09.1.454.CMB.2.raw
  modified_base (436)..(436): a, c, t, g, unknown or other
  modified_base (452)..(452): a, c, t, g, unknown or other
  modified_base (619)..(619): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcactggcctccgccgaggccgtccgggacgaagggggctgggaggtggggtggactaattatagtggtatgagtaggaaagtaaataaagactagtggtaggacgtaccggtaggaaggccgattaccacctatctacaagagaacaactacaaagaactactcttcttacacaaatcgaacaacgctggaggacggacgaaggacgacgggactaagttgtaattacggngtagacgtaagagtanacgtacaagtacgaacggttaaacggggaaattcgggttttagacgttacgtacgggttacggggaaccgtaagggtactaccggtcggtcctaccgttctcgttaacacgttcccaccgaacgacggtcccttacgttccggttcccttcccggcggccctcccgngcccgtcgaacggaaccg

SEQ ID NO: 386721 - DNA, 733 bp, Homo sapiens
  misc_feature: GZ8MTXP01CT8NG.22.86.H09.1.454.CMB.2.raw
  modified_base (205)..(205): a, c, t, g, unknown or other
  modified_base (222)..(222): a, c, t, g, unknown or other
  modified_base (236)..(236): a, c, t, g, unknown or other
  modified_base (238)..(238): a, c, t, g, unknown or other
  modified_base (260)..(260): a, c, t, g, unknown or other
  modified_base (271)..(271): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactgaaccagcagtnatgttggtgtataactntgtctctgtaccanancaccaggcaaacgccccagacncatctatttangctgtacaagtacgcgccctcgacgggtcccctagactcgctttcgctcggctaccagtctaccggacaacgccgtccctcccaacgacctcgtctcggtcgggctacccggaggtactaacggtaagtagtcggaacggtctacgttaacgtttacgttaacgttcgtccgttacggtcttacgttacgtttacggccggggtaaccggtccgttaccctaaacggttcggtttcggggcccggttttacggggaaccggggtaacgggaacccgtaacgggtccccgttacgggtaaccccggtttacggttaaccggttacccgaacccggtaccccggtaaccgggttccccgttaaccccgggttccccccgtttaacccggggttacccttaaccccggtttccccggtaccccgggttttaccccccccgtccccggtttaaccccgtaacccgg

SEQ ID NO: 386722 - DNA, 738 bp, Homo sapiens
  misc_feature: GZ8MTXP01DRMV2.22.86.H09.1.454.CMB.2.raw
  modified_base (281)..(281): a, c, t, g, unknown or other
  modified_base (626)..(626): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattccaccttcgagtggctagtggcatgcacgtggcctcccgcgaggccgtccgggagaagggggtctagggagggtggggtgactaatttagtagtaggtanggtaataggaaagtaaagtaaagtactagtacggtaggaccgtccggtaggaaacggtaccgtattaccacccgtatcctacgagaaccgtaacaactacaaacgaactctctttacgttaccaacaaagtcgaaacgacgactgggaacgagggacgaagacgtacggacgtagtagttacgttacgtggacgacgaaggtactacgtacgtaacgaagtaacggtaaaccggtaaacggttaaacgtttcggttttaaggtaccgttacggtaccgggtaaccggggaccgtaaacggaccgttaaccgtcgggttaccctaccgggtttctaccgttaaccnccgttacccggtacccgaaaccgggtaacgggtccccttaaccggttccggttcccccgtccccggttccgggccccgttccccggcgttaccctccgggaacgtaaccccg

SEQ ID NO: 386723 - DNA, 683 bp, Homo sapiens
  misc_feature: GZ8MTXP01AU1TO.22.86.H09.1.454.CMB.2.raw
  modified_base (214)..(214): a, c, t, g, unknown or other
  modified_base (297)..(297): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggtttttcctcgttgcttcttttaagaggtgtccagtgtcaggtncagctggtggagtcgtggggagcgtggtccagccgtgggacgtccctgacgctctcctgtgcagcgtctggtacttcaccttnagtcgctagtggcatcgacacgtcggacctcccgccgacgggccgtccggggacgaagggggtcctaggggtacggtggggtcgaacgtaaagtttaagtagttggtaaatagggaaagttaaacgggtaaaattaaagtaaacggtactagttggtacggtacgtaccgggtagggtaaacggtccgtaattccgaacctactaccgtacgacgtaacgaaccggaaacctacgaaacgtaacctacttccgttacgtttacctaaaccaaagttaccgaaactacggtacccgtaaggaacggacggtaaccggaacggaaccgtacgggaccttacggttaagttaacttaccgtggtacgcggaaagtcgttaacgtaaccg

SEQ ID NO: 386724 - DNA, 608 bp, Homo sapiens
  misc_feature: GZ8MTXP01E43FK.22.86.H09.1.454.CMB.2.raw
  modified_base (322)..(322): a, c, t, g, unknown or other
  modified_base (388)..(388): a, c, t, g, unknown or other
  modified_base (405)..(405): a, c, t, g, unknown or other
  modified_base (413)..(413): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaagggggctgggagtggggtgacaattatatggtatgataggaaataaagtaaagactatgtggactccgtgaagggccgtatcacatctcaganaacaactccaagaacactctcgtttcacaaatcgaacagcctgaggaggacgaggacacggcagtntatactgtgacgagganactacganagtagaacgtaacggggaaacgttcgttttacgagttccgtacggtaccgggggaccgaaacggggtacaacgtcggtcccaacccggtcttccttccgacgttccctacccaccgtaaaccgggccccaacgttcccgggttccctttcccccgcgggtcccgccccgttacggccctccgaacgggtaacccg

SEQ ID NO: 386725 - DNA, 545 bp, Homo sapiens
  misc_feature: GZ8MTXP01AD98F.22.86.H09.1.454.CMB.2.raw
  modified_base (228)..(228): a, c, t, g, unknown or other
  modified_base (347)..(347): a, c, t, g, unknown or other
  modified_base (412)..(412): a, c, t, g, unknown or other
  modified_base (522)..(522): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggnaagggggctgggagtgggtgcaattatatggtatgatggaaagtaataaagactatgtggactccgtgaaaggccgattcaccatctcagagacaactccaagaacactctacgtttcncgaaatgaacagcctgacgaggcgagtacaacggcagtagtattacgagtgacgagagatacganagtgaactacgggaaatcgttttgatcgtagtagggccaaagggactacgtggtcctacgtcctcttcacgcctccaccgtaacgggcccacgttcggttccttccccgngccgccctggacctcgcgaaccg

SEQ ID NO: 386726 - DNA, 516 bp, Homo sapiens
  misc_feature: GZ8MTXP01DYSVE.22.86.H09.1.454.CMB.2.raw
  modified_base (235)..(235): a, c, t, g, unknown or other
  modified_base (290)..(290): a, c, t, g, unknown or other
  modified_base (326)..(326): a, c, t, g, unknown or other
  modified_base (333)..(333): a, c, t, g, unknown or other
  modified_base (343)..(343): a, c, t, g, unknown or other
  modified_base (346)..(346): a, c, t, g, unknown or other
  modified_base (352)..(352): a, c, t, g, unknown or other
  modified_base (358)..(358): a, c, t, g, unknown or other
  modified_base (404)..(404): a, c, t, g, unknown or other
  modified_base (486)..(486): a, c, t, g, unknown or other
  modified_base (497)..(497): a, c, t, g, unknown or other
  modified_base (503)..(503): a, c, t, g, unknown or other
tcagacatacgcgtcacgaccggtgctcgatttagtgctatagacttgggtttgggggggaagaggaagactgacggtcctgccacaggtggtgctgggcacggttggcactcgacacaacatttgcgctcaactgtcttgtctcaccatggagtttgggctgagctgggttttcctcgttgctcttttaagaggtgtccagtgtcaggtgcagctggtggagtcgtgggggagngtggtccagccgtgggagtccctgagactctcctgtgcagcgtctggattcactnagtgctatggcatgcatggctccgcaggctccgggnaaggggntggagtgggnganattaanatggangataggaaataataaagctatgtagactcgtagaaggcgatcacanctaccagacgaacaaactacaaacgaacactctgttactaacaaatcgaaacagccaaggacgaggacgaaggacacgacgngttagtaatangtacgngagaagttcaacg

SEQ ID NO: 386727 - DNA, 659 bp, Homo sapiens
  misc_feature: GZ8MTXP01AQD1Z.22.86.H09.1.454.CMB.2.raw
  modified_base (466)..(466): a, c, t, g, unknown or other
  modified_base (542)..(542): a, c, t, g, unknown or other
  modified_base (576)..(576): a, c, t, g, unknown or other
tcagacatacgcgtcacgaccggtgctcgatttagtgctatagacttgggtttgggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagcgtggtggagtcggtgggggaggcgtggtccaggccgtgggacgtcctgacgtctctctgtgcagcgtctggattccacttgagtggctagtggcatgcacgtggcctccgccgacggccgtccgggagaacgggggtcgtagggtaggtcggggtagactaaagtttgtaacgtgggtatggtaagtaggaaaaaagttaaaagtaagtctaagtgggtacggtaccgttccgggagggaaacggggcccttaattaccgaacctntccgtaacgagaacgaccaaacctccaaaagacctacgtttacttcggtttaaaccctacgtaaacgtacgaaacnccggtacgtaggaagggacgggcgaacggtaacnccggtaagtagttagtttacttcggtagacgttaggagaacgtcgacgtaagagtacggttaaccgtaaggttaacgtttccg

SEQ ID NO: 386728 - DNA, 612 bp, Homo sapiens
  misc_feature: GZ8MTXP02GYMBA.22.86.H09.1.454.CMB.2.raw
  modified_base (261)..(261): a, c, t, g, unknown or other
  modified_base (268)..(268): a, c, t, g, unknown or other
  modified_base (272)..(272): a, c, t, g, unknown or other
  modified_base (277)..(278): a, c, t, g, unknown or other
  modified_base (282)..(282): a, c, t, g, unknown or other
  modified_base (318)..(318): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtctgggggagcgtggtccagcctgggaggtccctgagctctcctgtgcaaagcgtctggtntctctcngtgntatgnntgcncgtgctccgcgcgcgtccgggcggacgggcggtggnggtgggtggacgtattatagtaggtagtagtagtaggtaaagtaaagtaaagtaagtagtaggtaggtacgtacgtacggtaacgggaccgtacgttaccgtaccgtactaccgtaccgaacgaacgaaaccgaaacctaaaccgaaacgaaacctaaccttacgttacgtttaccttaacctaaaacgtaacgtaaacgtaacgtacgtacggaaggacgggacggaacggacggacggacgtagtacgttacgttacgtagtgaagagagacgtacgacgacgtacgtaacg

SEQ ID NO: 386729 - DNA, 568 bp, Homo sapiens
  misc_feature: GZ8MTXP02GRH3M.22.86.H09.1.454.CMB.2.raw
  modified_base (341)..(341): a, c, t, g, unknown or other
  modified_base (359)..(359): a, c, t, g, unknown or other
  modified_base (385)..(385): a, c, t, g, unknown or other
tcagacatacgcgtcacgaccggtgctcgatttagtgctatagacttgggtttgggctgagcgtggtttcgtcgtagctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattatatggtatgatggaagtaataaagactatgtggactccgtgaaggccgattcaccatctccagagacaactccaaagaacactctgtttcnccaaatgaacagcctganaggcgaggacacggcagtgtattacngtgagagagatacgacagtagacgtaacggtaaagtacgtttagtagtacgtacgtacgggacggaacggacgacgtacggtcgtaccgtcgtcttacgtacgacctacccgaccgaccggacccgtaccgtaccggttcccgttccccgtccggtccgtcccgtccgtccgtccgacggacg

SEQ ID NO: 386730 - DNA, 563 bp, Homo sapiens
  misc_feature: GZ8MTXP02IEYSU.22.86.H09.1.454.CMB.2.raw
  modified_base (403)..(403): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctgtttctccaaatgaacagcctgagaggcgagacacggcagtgtatactgtgcgagagatcgacaanagacgtaacggaaagtacgtttagtatcgtcgtacgggacgaacggacgacgtacgtcgtaccgtctcttactacgcctacccgaaccgaaaccggacccgtaccgttaccggttcccgttccccgtccggtcccgtcccgtccgtccgtccgacggacg

SEQ ID NO: 386731 - DNA, 542 bp, Homo sapiens
  misc_feature: GZ8MTXP02H0C4E.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtggcaattatatggtatgatggaagtaataaagactatgtggactccgtgaaggccgatcaccatctcagagacaactccaaagaacactctgtttctaccaaatgaacagcctgagaggcgagacacggcagtgtattactgtgcgagagatcgacatgaactaacgggaaagtcttttagatcgtcgtaggggaccaaaggggacacgtcgggtcaccgtcttcttacacgtccctaccaaccgaaacgggcccaacgtccggtccttcccccgtggcccgccctgccctcgacggcc

SEQ ID NO: 386732 - DNA, 513 bp, Homo sapiens
  misc_feature: GZ8MTXP02JHVZL.22.86.H09.1.454.CMB.2.raw
  modified_base (405)..(405): a, c, t, g, unknown or other
  modified_base (411)..(411): a, c, t, g, unknown or other
  modified_base (419)..(419): a, c, t, g, unknown or other
  modified_base (430)..(430): a, c, t, g, unknown or other
  modified_base (433)..(433): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggagtggggtggcaaagttatatggtatgatggaagtaataagctatgtgactcgtgaaggcgatcaccatctccagagacaacnccaaanacactctnttctacaatanaanacgacagagaggagagacgacgacgagtagtactagtagtcgacgagagaagacgacactagacgtaacggtaacgtacg

SEQ ID NO: 386733 - DNA, 606 bp, Homo sapiens
  misc_feature: GZ8MTXP02ISO9N.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcacgtcggcctcccgccgaggccgtccgggcgaaggggctaggggaggtggggtgacctaagttatagtggtatggaagtaggggtaaaattaaactaaaggacttaagtggtacggtaaccgtccgggtaggaacggggtcctattacccaacctataccgtaccgaagaacgaccaaacctaccgaaaacgtaacctactttacttacgtttaccaacctaaatacgaaacacgcaggagacggacgaacggacgtacggactaggttagttaacgttacgtgtagaacgagacgatacgactagtacgaaacgg

SEQ ID NO: 386734 - DNA, 553 bp, Homo sapiens
  misc_feature: GZ8MTXP02FSM0G.22.86.H09.1.454.CMB.2.raw
  modified_base (386)..(386): a, c, t, g, unknown or other
  modified_base (390)..(390): a, c, t, g, unknown or other
  modified_base (402)..(402): a, c, t, g, unknown or other
tcagacatacgcgtcacgaccggtgctcgatttagtgctatagacttgggtttgggctgagcgtggtttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactcgtgaaggccgattcacatctcagagacaactccaaagaacactctgtttctaccaaaatgaacagcctgagaggcgaggacacgggcagtgtattacngtgngagagatcgaanatagacgtaacgggaatcgtttagatcgtcggtacgggaccgaagggactacgtcggtcctaccgtctacgtcacgtccctaccgaaccgaacggccctacgtcccggttcccttcccccgtcggacccgcccgtcgccgtaccgacgacg

SEQ ID NO: 386735 - DNA, 583 bp, Homo sapiens
  misc_feature: GZ8MTXP02HYFT7.22.86.H09.1.454.CMB.2.raw
  modified_base (386)..(386): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaaggggctggagtgggtggcaattatatggtatgatggaagtaataaagactatgtggactcgtgaaggccgattcaccatctcagagacaactccaaagaacactctgtttctaccaaatgaacagcctgagaggcgagacacggcagtgtattacngtgcgagagatcgacatgaacgtaagggaaagtcttttagattccgtgtacgggggaccaaaggggacctaacgtcgggtaccaaccggttccttaccgttacaccgtccctaacccgaaccggtaaaccgggcccctacgtcccggttccccttcccccgtcgggccctccccgtcgcccgtaccgaacgggcccg

SEQ ID NO: 386736 - DNA, 553 bp, Homo sapiens
  misc_feature: GZ8MTXP02I28OM.22.86.H09.1.454.CMB.2.raw
  modified_base (354)..(354): a, c, t, g, unknown or other
  modified_base (392)..(392): a, c, t, g, unknown or other
  modified_base (399)..(399): a, c, t, g, unknown or other
  modified_base (406)..(406): a, c, t, g, unknown or other
tcagacatacgcgtcacgaccggtgctcgatttagtgctatagacttgggtttgggctgagctgggtttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactcgtgaaggccgattcacatctccagagacaactccaaagaacactctgtttctaccaaaatgaacancctgagaggacgagacgacggcgagtagtattatgtgngagaganacgacanagacgtaacggaaagtagttagtatcgtcgtacggacgaacggacgacgtcgtcgtacgtctctactacgacctaccgaccgaaccggaccgtacgtccgttcccgttccccgtccggtcccgtcccgtccgtccgtccgacggacg

SEQ ID NO: 386737 - DNA, 539 bp, Homo sapiens
  misc_feature: GZ8MTXP02FXTZT.22.86.H09.1.454.CMB.2.raw
  modified_base (404)..(404): a, c, t, g, unknown or other
tcagacatacgcgtcacgaccggtgctcgatttagtgctatagacttgggtttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgtatactatgtctctgtacacagcaccaggcaaagccccagactcatcatttatgctgtacaagtaacgccgcctcgacggggtccccctgactcgtcttctctggctcaagtctgccaacacggtccctacctgacctatctctgggcctccgaggctagagntaggagtctagtatttattacgtgcctgtccttgtacgttgacgtacggtccgtaccgtacgtacggtttcggggtcggttacgggacggtacggaccgagtcgtacgaccgtcgtacgtcgacggaccgtacgg

SEQ ID NO: 386738 - DNA, 501 bp, Homo sapiens
  misc_feature: GZ8MTXP02GTHL8.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtggctatggcatgcactggctccgccaggctccgggcaggggctggagtgggtgcaattatatggtatgatgggaaagtaaataaagactatgtgactcgtagaagggccgattcaccatctccagagacaactaccaaagaacactctgtttcctaccaaatgaacagcctgagaggacgaggacacggcagtactagtactgtgaacgagagatcgacagtacgaacg

SEQ ID NO: 386739 - DNA, 609 bp, Homo sapiens
  misc_feature: GZ8MTXP02JBCTW.22.86.H09.1.454.CMB.2.raw
  modified_base (356)..(356): a, c, t, g, unknown or other
tcagacatacgcgtcacgaccggtgctcgatttagtgctatagacttgggtttgggctgagcgtggtttcgtcttaggctctttaagtaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggatccgtgaaggcgattcaccatctccagagacaactaccaagaacactctcgtttctccaatgaaaaaacncgctgagaggacgagacgacggacgagtagttattacgtgtgacgagagacgtacgacgagtacgtaacgtaacgggtaaacggttacgtttacgttagttacgttacggtacgggtaccggaacgggacgtacgtacggtacgtaccgtcgttccgttaccgtacgtacccgtacccgacccgaaccggacccgtaccgtccgttcccgttccccgtcccggtcccgtcccgtccgtccgtaccgacggacg

SEQ ID NO: 386740 - DNA, 529 bp, Homo sapiens
  misc_feature: GZ8MTXP02F9RGP.22.86.H09.1.454.CMB.2.raw
  modified_base (387)..(387): a, c, t, g, unknown or other
  modified_base (482)..(482): a, c, t, g, unknown or other
  modified_base (517)..(517): a, c, t, g, unknown or other
  modified_base (522)..(522): a, c, t, g, unknown or other
tcagacatacgcgtcacgaccggtgctcgatttagtgctatagacttgggtttgggctgagcgtgggtttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactcgtgaaggccgattcaccatctccagagacaactccaaagaacactctgtttctaccaaatgaacagcctgagaggcgagacacggcagtgtattacngtgcgagagactcgaacagtagacgtaacgggaaagtacgtttagtatctcgtgggaccgaacggacgaacgtcgtcgaccgtctcttcacgccnccaccacggccacgtcggtcctcccgtcgccgccncgccncgacgcg

SEQ ID NO: 386741 - DNA, 497 bp, Homo sapiens
  misc_feature: GZ8MTXP02FO0YJ.22.86.H09.1.454.CMB.2.raw
  modified_base (240)..(240): a, c, t, g, unknown or other
  modified_base (351)..(351): a, c, t, g, unknown or other
tcagacatacgcgtcacgaccggtgctcgatttagtgctatagacttgggtttgggaggagagaccctccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaanagcacccaggcaaagcccccagactcatcatttatgctgtcaataagcggccctcaggggtccctgatcgcttctctggctccaagtctggcaacacggcctccctgaccntctctgggctccaggctgaagatgaggctgattatactgctgctcatttgcaggcgcctacacttcgggtgttcggcggagggccaagctgaccgtccaggtcagcccaaggctcgccccctggtcactctcgttcccacctctcc

SEQ ID NO: 386742 - DNA, 534 bp, Homo sapiens
  misc_feature: GZ8MTXP02HOB5P.22.86.H09.1.454.CMB.2.raw
  modified_base (343)..(343): a, c, t, g, unknown or other
  modified_base (402)..(402): a, c, t, g, unknown or other
  modified_base (419)..(419): a, c, t, g, unknown or other
tcagacatacgcgtcacgaccggtgctcgatttagtgctatagacttgggtttgggctgagcgtggtttcctcgttgctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtgggtggcaattatatggtatgatggaagtaataaagatatgtggactccgtgaaggccgattcaccatctccagagacaactccaaagaacactctgtttacnccaaatgaacagcctgagaggcgaggacacggcagtgtattactgtgcgagagatcganatagacgtaaggaagtntttagatcgtgtagggacgaaggacacgtcgtctaccgtctctcacgtcctccgaaccgacggccctacgtccggtcccttccccgtcggcccgtccctaccgcctccgacgacg

SEQ ID NO: 386743 - DNA, 603 bp, Homo sapiens
  misc_feature: GZ8MTXP02F1AYK.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactcgtgaaggccgatcaccatctccagagacaactccaaagaacactctcgtttcaccaaaatcgaacaagcctgacgaggacgagacacggcagtgtattactgtgcgagagatcgacatgaacgtaacggggaaaagtctttttaggaattcttcgtagggggacccaaagggggaccaacgttcgggtccaacccggtcttaccttcgacgcccttcccaaaccgaaacggggtcccccaacggttcccggttacccttcccccccgttcggggtccccggacccccttcggcccttcccgaacggggaacccg

SEQ ID NO: 386744 - DNA, 585 bp, Homo sapiens
  misc_feature: GZ8MTXP02GKJ30.22.86.H09.1.454.CMB.2.raw
  modified_base (160)..(160): a, c, t, g, unknown or other
  modified_base (219)..(219): a, c, t, g, unknown or other
  modified_base (242)..(242): a, c, t, g, unknown or other
  modified_base (329)..(329): a, c, t, g, unknown or other
  modified_base (340)..(340): a, c, t, g, unknown or other
tcagacatacgcgtcacgaccggtgctcgatttagtgctatagacttgggttggctgagctgggtttcctcgttgctctttaagaggtgtccagtgtcaggtgcagctggtggagtctgggggagcgtggtccagcctgggaggtccctgagactcttcngtgcagcgtctggattcaccttcagtggctatggcatgcactggctcgcaggctcgggnaggggctggagtgggtgcaattnatggtatgatggaagtataagctatgtggactccgtgaaggccatcacctatcctcagagacactccaagactacgtctcgtttacnccaaatgaacngtccctgacgtacggcgaggacacggctagtgtacttacgtgtgcgtagtagagtcgatacgtgactacggggaaatccgttttagacgttcgtacggtacggggtaccctaagggtaccgtacgtcgggtacccgtaacgtcgttacgttaccgacggtcccttaccgtaccgtacgggggccctaacgttcccggtaccttccccgtggtcccgtacccgtgtaccgtaccgtacggtacccg

SEQ ID NO: 386745 - DNA, 561 bp, Homo sapiens
  misc_feature: GZ8MTXP02G9TBO.22.86.H09.1.454.CMB.2.raw
  modified_base (523)..(523): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtggactccgtgaaggccgattcaccatctccagagacaaactccaaagaacactctcgtttcaccaaatgaaacagcctgagaggcgagacacggcagtgtatactgtgcgagagatcgaacatgacgtaaacgggaaatcttttgaatctcgtaggggaccaaagggacacgtggtccaccgtctcttcacgccctaccaaccgaaacgggccccaagtcccggtccctttcccccgnggggccccgtcccctcgacccttccccgaagggacccg

SEQ ID NO: 386746 - DNA, 507 bp, Homo sapiens
  misc_feature: GZ8MTXP02HK5BV.22.86.H09.1.454.CMB.2.raw
  modified_base (334)..(334): a, c, t, g, unknown or other
  modified_base (463)..(463): a, c, t, g, unknown or other
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtggctatggcatgcactggctccgccaggctccgggcaaggggctgggagtgggtgcaattanagtggtatgataggaaagtaataagctatgtgactccgtagaacgggccgattcacatctaccagagacaacacaagaacactctgttactacaaatcgaacagcctgagaggacgagacacggcagtntactactgtgtgagagaagtcgactatagactaacgggaaatcg

SEQ ID NO: 386747 - DNA, 590 bp, Homo sapiens
  misc_feature: GZ8MTXP02IGN9B.22.86.H09.1.454.CMB.2.raw
  modified_base (386)..(386): a, c, t, g, unknown or other
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaaggggctggagtgggtggcaattatatggtatgatggaaagtaaataaagactaatgtggaactccggtagaacgggccgatacaccatctaccagagacaactccaaagaacctactcttctttacctaccaaatcgaacagcctgagaggcgagacncggctagtntatactgtgcgagagatcgaacatagacgtaaacgggaaagtcgtttttagaacttcgtacgtaggggaccgaaaggggactacgtcgggtcctaccggtctcctttcaacgttcccacccaaccgaacggtccccacgttcccggtccctttcccccggtcggccccgtcccgtacgcccgtaccgacggcccg

SEQ ID NO: 386748 - DNA, 537 bp, Homo sapiens
  misc_feature: GZ8MTXP02G9XZL.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaagggccgattcaccatctccagagacaactccaaagaacactctcgtttctaccaaatgaactagcctgagaggcgagacacggcagtgtatactgtgcgagagatcgaactatgaactaacgggaaagtcttttggattctcgtggggaccaagggacacgtggtcaccgtctcttcacgccctaccaccgaacggcccatccggtccttcccccgtggcccgccctgcctccgacggacg

SEQ ID NO: 386749 - DNA, 663 bp, Homo sapiens
  misc_feature: GZ8MTXP02F9IJ8.22.86.H09.1.454.CMB.2.raw
  modified_base (206)..(206): a, c, t, g, unknown or other
  modified_base (239)..(239): a, c, t, g, unknown or other
  modified_base (273)..(273): a, c, t, g, unknown or other
  modified_base (355)..(355): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtnatgttggtgttataactatgtctcctgtaccangcaccaggcaaacgccccagactcatcatttacngctgtcaatacgcgcctcgacgggtccctgactcgtcttctctcggctcgaagtctacggacaacgacggcctcctcgaccnttcctcgtcgggcctccgaggtctagaaagtcgtagacgtctaggtaactttactacgtcgtacttggtaccttacgtacgtttcggaccgtacgggtacccgtaccttaaccggtacggtttcggggtccggtttacggggaccgggtaaacggggtaccaaacggttccgttaacggtacccggttaccgttaacgggtaccgtaaaccggtacccgaaacgggttcccgtaacccggtcccccgttaacggggtacctaacccggttccgttaccggttcccccgtacccgtttccgtaacccgg

SEQ ID NO: 386750 - DNA, 678 bp, Homo sapiens
  misc_feature: GZ8MTXP02HIYLX.22.86.H09.1.454.CMB.2.raw
  modified_base (187)..(187): a, c, t, g, unknown or other
  modified_base (239)..(239): a, c, t, g, unknown or other
  modified_base (248)..(248): a, c, t, g, unknown or other
tcagacatacgcgtcacgaccggtgctcgatttagtgctatagacttgggtttgggctgagcgtggtttcgtcgtaggctctttaagaggtgtccagtgtcaggtgcagctggtggagtctgggggaggcgtggtccagcctgggaggtccctgagactctcctgtgcagcgtctggattcaccttnagtggctatggcatgcactggctccgccaggctccgggcaaggggcgtgggnggtggtggntatatagtgtagtgagtaggaagtaaataaagtaactagtagtaggtacgtaccggtaggaacgggaccgtacttacctacctactacctaccgacgacgaacaacctaaccaaacgaaacctaactacttaccgtttaccttacctaaactaacgtaacgaacgtacgtcgaggacggacggacggacgacggacgtagtagtagttacgtagtagacgagagacgtacgacgacgtacgtaacgtaaacgggtaaacggttacgtttacgttacgttacgttacggtacgggtaccggaacggacgtacgtacggtaccgtaccgtacgttaccttacgtacgtaccctacccaccgaaccggtacccgtaccgtaccgttcccgttccccgtcccggtcccgtcccgtccgtccgtaccgacggacg

SEQ ID NO: 386751 - DNA, 565 bp, Homo sapiens
  misc_feature: GZ8MTXP02F02ZR.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcaccatctccagagacaactccaaagaacactctcgtttctccaaatgaacagcctgagaggcgagacacggcagtgtattactgtgcgagagatcgacatagacgtaacggggaaaatcgttttagattcgtacgtaggggacccgaaagggggactacgtcgggtaccaccggttctcttacacgccctcccaaccgaacgggcccctacgtccggtacccttcccccgtggcccgtccccgtgcctccgacgggaccg

SEQ ID NO: 386752 - DNA, 588 bp, Homo sapiens
  misc_feature: GZ8MTXP02JPSZO.22.86.H09.1.454.CMB.2.raw
  modified_base (390)..(390): a, c, t, g, unknown or other
tcagacatacgcgtcacgaccggtgctcgatttagtgctatagacttgggtttgggctgagcgtggtttcgtcgttaggctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtagaaggccgattcaccatctccagagacaactccaaagacactctgttctaccaaatgaacagcctgagaggcgaggacacggcatgtattactggngagagagacgcgaacagtagaacgtaacgggaaagttcgtttagacgttcgtacgggtacggggaaccgaagggacctacggtcggtaccgtacccgttcttcctacgaccgtacccgtacccgaaccgaaccggacccgtaccgtcccggttcccgttccccgtccggtcccgtcccgtccgtccgtccgacggacg

SEQ ID NO: 386753 - DNA, 595 bp, Homo sapiens
  misc_feature: GZ8MTXP02JRMIK.22.86.H09.1.454.CMB.2.raw
  modified_base (226)..(226): a, c, t, g, unknown or other
  modified_base (387)..(387): a, c, t, g, unknown or other
  modified_base (395)..(395): a, c, t, g, unknown or other
  modified_base (408)..(408): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctgggagtgggtggcaattatatggtatgatggaaagtaataaagactatgtggactccgtagaaggccgattcaccatctccagacgacaactaccaaagaacactctcgtttacaccaaatcgaacagcctggagaggcgagacacggcagtntattacgngtagcgagagtanacgaacagtacgaacgtaaacggggtaaattccgttttagacttcgtacggtacggggacctaaaggggacctacgtcggtacctaccgtctccttacgacgtccctaccgaaccgaacgggcccctaacgttcccgggtacccttcccccgtcggcccgtcccgttcggccctacccgaggacccg

SEQ ID NO: 386754 - DNA, 509 bp, Homo sapiens
  misc_feature: GZ8MTXP02H5XBI.22.86.H09.1.454.CMB.2.raw
  modified_base (500)..(500): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcctccggggcaaggggctgggagtggggtggccaattatatgggtatgatgggaaagtaataaagactatgtggactcgtgaaggccgattcaccatctccagacgacaactacaagaacactctgtttcaccaaatgaactagcctgagaggcgaggacacggcagtgtactacgtgtgaacgagagactcgacngtacgaacg

SEQ ID NO: 386755 - DNA, 510 bp, Homo sapiens
  misc_feature: GZ8MTXP02GA9CE.22.86.H09.1.454.CMB.2.raw
  modified_base (309)..(309): a, c, t, g, unknown or other
  modified_base (482)..(482): a, c, t, g, unknown or other
  modified_base (499)..(499): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgcaggctccgggnaggggctgggaggtgggtggccaattatagtggtatgatgggaaataaataaagctagtgtgactcgtagaggcgattcacatctacagacgacaactacaaagaacacttctagtttaccaccaaatcgaactagcctagagaggcgaaggacaggctagtacgtattacgngtgaagagagactcganacgtagaacgg

SEQ ID NO: 386756 - DNA, 559 bp, Homo sapiens
  misc_feature: GZ8MTXP02HOMBK.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaaagaacactctcgtttcaccaaatgaaacagcctgagaggcgaggacacggcagtgtattactgtgcgagagatcgacatgacgtaacgggaaatcttttagattctacggtggggccaaaggggacacgtcggtcctaccgtcttaccttcgacgtccctaccgaaccgaacggggccccagttcccggtccttcccccgtggcccgtcccccgtgccctcccgaggaccg

SEQ ID NO: 386757 - DNA, 594 bp, Homo sapiens
  misc_feature: GZ8MTXP02IQU4L.22.86.H09.1.454.CMB.2.raw
  modified_base (188)..(188): a, c, t, g, unknown or other
  modified_base (251)..(251): a, c, t, g, unknown or other
  modified_base (268)..(268): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgtaggctctttaagaggtgtccagtgtcaggtncagctggtggagtcgtgggggagcgtggtccagccgtgggaggtccctgagctctcctgtgcngcgtcgtgactcacttnagtgctagtgcatcgctacgtcggcctaccgcgacggccgtaccggggacggaacggggcgtaggggaggtggggtagtacgtaaagttagtagtaggttagtaggaagtagggtaaattaaagtaaacgtacgttagtggtacggtaccgtacggtaggaacggtcctataccactatcgacgaagacgacaactacaaatactacttcttacttactaacaagtacgaacacgacgaggagacgacggacggtacgacggtactagttacgttacgttacgtggtacgaacggaggacgtacgtacgacgtacgtacgtaacgg

SEQ ID NO: 386758 - DNA, 530 bp, Homo sapiens
  misc_feature: GZ8MTXP02HZ8C5.22.86.H09.1.454.CMB.2.raw
  modified_base (340)..(340): a, c, t, g, unknown or other
tcagacatacgcgtcacgaccggtgctcgatttagtgctatagacttgggtttgggctgagcgtggtttctcgttgctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaaggggctggagtgggtggcaattatatggtatgatggaagtaataaagactatgtggactccgtgaaggccgattcaccatctccagagacaactccaaagaacactctcgtttcnccaaatgaacagcctgagaggcgagacacgggcagtgtatactgtgcgagagatcgacatgactaacggggaaatcttttgatcgtcgtgggggccaaaggggacacgtggtcaccgtctcttcacgcctccaccgaacggaccgactccggtccttccccgtccggccgcccgtcgccgtccgacgacg

SEQ ID NO: 386759 - DNA, 534 bp, Homo sapiens
  misc_feature: GZ8MTXP02H8S0P.22.86.H09.1.454.CMB.2.raw
  modified_base (505)..(505): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctgttctccaaatgaacagcctgagaggcgagacacggcagtgtatactgtgcgagagatcgacatgactacgggaaatctttggatcgtcgtggggccaagggacacgtggtccacgtctacttcacgcctaccaccgaacgggccccacgttccggcctttcccccgnggcccgtcccgtgccctaccgaacggccg

SEQ ID NO: 386760 - DNA, 562 bp, Homo sapiens
  misc_feature: GZ8MTXP02ISR9O.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggacaaggggctggagtgggtggcaattatatggtatgatggaaagtaataaagactatgtggactccgtgaagggccgattcaccatctccagagacaactccaaagaacactctgtttctaccaaatgaacagcctgagaggcgagacacggcagtgtattactgtgcgagagatcgacatagacgtaacgggaaatcgtttagatctacgtcggggacccgaaggggacacgtcggtactaaccggtctccttacacgtccctacccgaaaccgaacggggccccacgttccggtcccttcccccgtggcccgtcccctgccctccgacggacccg

SEQ ID NO: 386761 - DNA, 536 bp, Homo sapiens
  misc_feature: GZ8MTXP02JTRZC.22.86.H09.1.454.CMB.2.raw
  modified_base (343)..(343): a, c, t, g, unknown or other
  modified_base (512)..(512): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctggaggtgggtggcaattatatggtatgatggaagtaaataaagactatgtggactccgtgaaggccgatcacatctccagagacaactcaaagaacactctgtttcnccaaatgaacagcctgagaggcgaggacacggcagtgtattactgtgcgagagatcgacagtgacgtaacgggaaatctttagatctcgtggggaccaagggacacgtggtaccaccgtctcttcgacgccctaccgaccgaacgggcccagtccggtccttcccccgnggcccgccctgcctcgacggaccg

SEQ ID NO: 386762 - DNA, 687 bp, Homo sapiens
  misc_feature: GZ8MTXP02GZUGK.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccgaggccgtccgggagaggggcgtgggaggtgggtggactaattatagtggtatgagtaggaaagtaaataaacgtactagtggtaggtactccggtaggaacggccgtattccacctagtcctaccgaagaacgaacctaacctaccgaaaagaacctacttacttccgttttacctaaccctaaagttacgaaactacgtaccctagggaacggacggggaccggaaaggaccgacgggacgtaaggttagttactttaacggtggtacgacggaagtaagacgtacgaacgtagtacggaaccggttaaacgggtaaagtttcttttggaacttccgtacgggtacggggaccgtaaaggggacctacggttcggtacctaccgtcttcttacgaccgtccctaccgaaccgacggccctacgtcccgtcccttcccgcggcccgtcccgtgcccgtacgaggtacccg

SEQ ID NO: 386763 - DNA, 541 bp, Homo sapiens
  misc_feature: GZ8MTXP02I29D2.22.86.H09.1.454.CMB.2.raw
  modified_base (386)..(386): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcactggcctccgccagggccgtcccggggcaaggggctggggaggtggggtggaccaattatagtggtatggatggggaaataaataaagacttagnggtaggactccggtaggaacggccgattcaccatctcagacgacactaccaagaacacttcttacgtttactaaccaaatacgaacacgcctagagacggacgaggacacggcagttagtacttacgtgtagcgagagactcgacagtagtaacg

SEQ ID NO: 386764 - DNA, 557 bp, Homo sapiens
  misc_feature: GZ8MTXP02GYE7B.22.86.H09.1.454.CMB.2.raw
  modified_base (227)..(227): a, c, t, g, unknown or other
  modified_base (252)..(252): a, c, t, g, unknown or other
  modified_base (343)..(343): a, c, t, g, unknown or other
  modified_base (380)..(380): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattntatggtatgatggaagtaataaagactatgtggactccgtgaagggccgattcaccatctccagagacaactccaaagacactctgtttcnccaaatgaacagcctgagaggcgaggacacggcagtntattactgtgcgagagatcgacatgacgtaacgggaaagtcttttgatcgtcgtaggggaccctaaaggggacacgtacgggtccaaccggtctcctttcgacgtccctacccaaccgaaacgggcccctaacgtccggtcccttcccccgtcggccgcccctgcctccgaggaccg

SEQ ID NO: 386765 - DNA, 514 bp, Homo sapiens
  misc_feature: GZ8MTXP02FQLJ9.22.86.H09.1.454.CMB.2.raw
  modified_base (344)..(344): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtcccctgagactctcctgtgcagcgtctggattcaccttcagtggctatggcatgcactggctccgccaggctcccggggcaagggggctggagtggggtggccaattanatggtatgatgggaaataataaagactatgtggactcgtgaaggccagttcacatctccagagacaactaccaaagaacactctgtttactaccaaaatgaaacagcctgaagaggacgaggacacggcaagtcgtacttactgtagcgagagatcgaacacgtagaacg

SEQ ID NO: 386766 - DNA, 522 bp, Homo sapiens
  misc_feature: GZ8MTXP02HBVVI.22.86.H09.1.454.CMB.2.raw
  modified_base (241)..(241): a, c, t, g, unknown or other
  modified_base (275)..(275): a, c, t, g, unknown or other
  modified_base (351)..(351): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaagccccagactcatcatttangctgtcaataagcggccctcgacggggtccctgatcgcttctctggctccaagtctggcaacacgcctcctgaccntctctgggcctccgaggctagaagatgagctgattattactgctgctctatttgcgaggcgtcctacgtacgttgggtgttcgggcgggacgggaccgaagcgtcggtaccgtccgtaggtcacgcccgaaggcctcgccccgtggtcactcgtccgtcccgcctcctccg

SEQ ID NO: 386767 - DNA, 542 bp, Homo sapiens
  misc_feature: GZ8MTXP02GAZFD.22.86.H09.1.454.CMB.2.raw
  modified_base (189)..(189): a, c, t, g, unknown or other
  modified_base (228)..(228): a, c, t, g, unknown or other
  modified_base (253)..(253): a, c, t, g, unknown or other
  modified_base (351)..(351): a, c, t, g, unknown or other
  modified_base (355)..(355): a, c, t, g, unknown or other
  modified_base (358)..(358): a, c, t, g, unknown or other
  modified_base (397)..(397): a, c, t, g, unknown or other
  modified_base (401)..(401): a, c, t, g, unknown or other
  modified_base (403)..(403): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaagcgtggtccagcctgggaggtccctgagactctcctgtgcagcgtctggattcaccttnagtggctatggcatgcactggctccgccaggctccgggnaaggggctggagtgggtgcaattanatggtatgatggaaagtaataaagatatgtggactccgtgaaggccgatcacatctcagagacaactccaaagaacactctagtttacaccaaataanacanacngagagacgagacgacgacagtagtatatgtgagagaganagananagacgtaaggtaagtattagtatcgtacgtacggacgaacggacgacgtacgtacgtacgtctctactacgacctaccaccgacgaccgtacgtccgttcccgtcccgtccgccgtcccgtccgtccgtaccgacgacg

SEQ ID NO: 386768 - DNA, 524 bp, Homo sapiens
  misc_feature: GZ8MTXP02GT2XT.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaaagaacactctgtttctccaaatgaacagcctgagaggcgagacacggcagtgtattacgtgtgcgagagatcgacatgactaacgggaaatcttttagatctcgtggggccaaaggggcacgtggtcaccgtctcttcagcctccaccaacgggcccatccggtcctcccccgtgccgccctgcctccgaggaccg

SEQ ID NO: 386769 - DNA, 506 bp, Homo sapiens
  misc_feature: GZ8MTXP02IBU3H.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgcaggctccgggcaggggctgggagtgggtggcaattatatggtatgatggaaagtaataaagactatggtgactccgtgaagggccgattcaccatctccagagacaactaccaaagaaccacttcttagtttctaccaaatgaacagcctgagaggcgaggacacggcaggtagtacttactgtagcgagagactcgacatgaacg

SEQ ID NO: 386770 - DNA, 557 bp, Homo sapiens
  misc_feature: GZ8MTXP02GPAXN.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactcgtgaaggccgatcacatctccagagacaactccaaagaacactctcgttcaccaaatcgaacagctgagaggcgagacaggcagtgtattactgtgcgagagatacgacagtagacgtaacgggaaagtctttagatcgtcgtagggaccgaagggacacgtcggtaccaccgtctcgttacacgtccctacccgaaccgtaaccggggcccctaacgtcccggttcccttcccccgtggccccgtccctcgccctccgacggacccg

SEQ ID NO: 386771 - DNA, 591 bp, Homo sapiens
  misc_feature: GZ8MTXP02HPC3R.22.86.H09.1.454.CMB.2.raw
  modified_base (156)..(156): a, c, t, g, unknown or other
  modified_base (228)..(228): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttcncgttagctcttttaagaggtgtccagtgtcaggtgcagctggtggagtctgggggagcgtggtcagctgggngtcgtgagactctctgtgcgagcgtcgtgtatctaccttcagtggcgtagtggcgatgcgtacgtcggccgtcccggccgacggccggtcccggggaccggaacggggacggtaggggtaggggtggggtggtaccgtaaagttaagttagttaggttagtagagtaggtaaagtaaaagtaaaagtaagtaagtagtaggtacgtacgtaggaaggacgtacgtacacactactacagaacgaacaactacaaacaaacactacttacttactacaaataagaacacgacgtagagaggacggacggacgacgacgagtacgtacgttacgtagtagaagagagagacgacacgtacgaacg

SEQ ID NO: 386772 - DNA, 671 bp, Homo sapiens
  misc_feature: GZ8MTXP02F8IOQ.22.86.H09.1.454.CMB.2.raw
  modified_base (314)..(314): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagatatgtggactcgtgaaggcgattcacatctccaganacaactccaaagaacactctcgtttctaccaaatcgaaacacgcctgagacggacggaggaccgacggacgaggttagtaatttacgtgtacggagaagagactacgaactagtacgaacggtaaaggggtaaagttcgtttttagacgttccgttacgggacgggggaaaccccgaaagggggtacctacggttacggggtaccctacccggttcttccttaccgaaccggtcccccttacccgaaacccgggaaacccggggtccccctaacggttccccgggtttacccccgttccccccggttcggggacccccgtcccccgttaggccccgtacccggacggggtaaccccg

SEQ ID NO: 386773 - DNA, 526 bp, Homo sapiens
  misc_feature: GZ8MTXP02JVKYV.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggcctcccgccagggcctcccggggcaaggggctgggagtggggtggccaattatatggtatgatgggaaataaataaagactagtggtggactccgtagaacgggccgattcaccatcctaccagacgacaactaccaaagaaccactctgtttacaccaaatcgaacagcctagagaggcgaggacacggcagtgtacttacgtgtgcgagagactacgactagtagaacgg

SEQ ID NO: 386774 - DNA, 574 bp, Homo sapiens
  misc_feature: GZ8MTXP02ISZDP.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgcactggctccgccgaggcctcccggggcgaaggggcgtggggaggtggggtggcctaagttatagtgggtatggatggggaaagtaaataaagtactaagtgtagggtactccggtaggaaacggggtccgaattcgaaccctatcctaccaagacgaaccaactaccaaacgaacctacttacttacgtttactaccaaatacgaaacagcctagaggagacggacggacacggactagtagttacgttacgtgtgaacgaggagactcgaacagtacgtaacgg

SEQ ID NO: 386775 - DNA, 511 bp, Homo sapiens
  misc_feature: GZ8MTXP02G80KH.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggggcaaggggctgggagtggggtggccaaattatatgggtatggatgggaaataataaagactatgtggactccgtgaacgggcgattcacatctccagagacaactacaaagaacactctgtttacctaccaaatgaaacagcctagagaggcgaggacacggacagtagtatacgtgtgcgagacgactcgacatcggaacg

SEQ ID NO: 386776 - DNA, 568 bp, Homo sapiens
  misc_feature: GZ8MTXP02IRUO4.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaaagacactctgtttctccaaatgaacagcctgagaggcgagacacgggcagtgtatactgtgcgagagatcgaacatagactaacggggaaatcttttagattctacgtcggggaccaaggggacacgtaggtcaaccgtctccttcacgtccctaccaaccgaaacggggtccccaacgttccggttcccctttcccccgtcgggcccggtccccctaggcccttacccgaacggtcccg

SEQ ID NO: 386777 - DNA, 561 bp, Homo sapiens
  misc_feature: GZ8MTXP02F0YQO.22.86.H09.1.454.CMB.2.raw
  modified_base (253)..(253): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattanatggtatgatggaaagtaataaagactatgtggactccgtgaaggccgattcaccatctccagagacaactaccaaagaacactctcgtttacaccaaaatgaaacagcctgagaggcgaaggacacgggcagtagtattacgtgtgcgagagatagacatagactaacggggaaatcttttaggatcgtacgtagggacccgaaggacacgtggactaccgtctacttcacgtccctccaaccaaacgggcccaacgtccggttcccgttcccccgtggcccgccccgtgtcctacccgaggacccg

SEQ ID NO: 386778 - DNA, 535 bp, Homo sapiens
  misc_feature: GZ8MTXP02F7EYO.22.86.H09.1.454.CMB.2.raw
  modified_base (344)..(344): a, c, t, g, unknown or other
  modified_base (518)..(518): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcacatctccagagacaactccaaagaacactctcgtttcnccaaatcgaacagcctgagaggcgagacacggcagtgtattactgtgcgagagatacgacagtagacgtaacggggaaatcgttttaggattcgtcgtggggaccaaggggacacgtggtccacgtctcttcacgcctaccaccgacggcccacgtccggtcctccccgcgccncctcgctacgacgaccg

SEQ ID NO: 386779 - DNA, 519 bp, Homo sapiens
  misc_feature: GZ8MTXP02I0P7C.22.86.H09.1.454.CMB.2.raw
  modified_base (200)..(200): a, c, t, g, unknown or other
  modified_base (240)..(240): a, c, t, g, unknown or other
  modified_base (349)..(349): a, c, t, g, unknown or other
  modified_base (408)..(408): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccngcagtgatgttggtgttataactatgtctctggtaccaangcacccaggcaaagccccagactcatcatttatgctgtcaataagcggccctcgaggggtccctgatcgcttctctggctccaagtctggcacacggcctccctgaccntctctgggcctccaggctgaagatgaggctgattatactgctgctcatttgctagggcnccctacgacgttggggtgttcgggcgggaagggacccaagcttcggaaccgtccgtaggtccagccccaaggcctcgcccccgtggtcactcctcgtccccgccctcctcg

SEQ ID NO: 386780 - DNA, 562 bp, Homo sapiens
  misc_feature: GZ8MTXP02IB78X.22.86.H09.1.454.CMB.2.raw
  modified_base (372)..(372): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctacactggaaccagcagtgatgttggtgttataactatgtctcctggtaccaacagcacccaggcaaacgcccccagactcatcatttatgctgtacaataacgccggaccctcgacggggtccccctgactcgcttctctggctccagtctggcaacncggccctccctgacccatctcgtcgggcctccgaggcctggaagatggacggtctagtatttattctgtcctgcttctatttgcgtacggccgtaccttacgtacgtttggggtcggtttccgggacgggtacgggacccaaaggtccgtcggacccgttcccgtaagggtccacggtaccccgaaccgg

SEQ ID NO: 386781 - DNA, 507 bp, Homo sapiens
  misc_feature: GZ8MTXP02GSQ8D.22.86.H09.1.454.CMB.2.raw
  modified_base (492)..(492): a, c, t, g, unknown or other
tcagacatacgcgtcacgaccggtgctcgatttagtgctatagacttgggtttgggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctcgggcaggggctgggagtgggtgcaattatatggtatgatggaagtaataaagactatgtaggactcgtgaaggccgattcaccatctccagagacaacgtaccaagaacactctgtttactaccaaatgaacagcctagagaggcgaggacacggcagtagtaagttacngtgacgagagatacg

SEQ ID NO: 386782 - DNA, 544 bp, Homo sapiens
  misc_feature: GZ8MTXP02I9A3R.22.86.H09.1.454.CMB.2.raw
  modified_base (525)..(525): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggtgtgggtgcaattatatggtatgatggaagtaataaagatatgtggactccgtgaaggccgatcacatctcagagacaactccaaagacactctcgtttcaccaaatcgaacagcctggagaggcgaggacacggcagtgtattactgtgcgagagactcgaacatagacgtaacgggaaagttctttagatctacgtaggggacccaaggggacacgtcggtaccaccgtctcttcgagccctaccaaccgaacgggtcccacgttccggtccctccccgtggccncccgtgcctccgacggacc

SEQ ID NO: 386783 - DNA, 597 bp, Homo sapiens
  misc_feature: GZ8MTXP02HS8LD.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcagtggctatggcatgcacgtggcctcccgccaggcctccggggacaaggggctgggaggtggggtgacctaattatagtggtatggaatggggaaagttaaataaaacggacttaagtggtacgggtaaccgtccgtaggaaacggggtcccgtaattccgaaccctattcccgtacccaagacgaaccaaacctaccaaacgaaacctacctttacttcgttttaccaaccctaaaatcgaaacacgcctagaaggaggaccggaaggacgtacggactaggtagtattacgtgtgaacgagagactacgacagttagaaacgg

SEQ ID NO: 386784 - DNA, 590 bp, Homo sapiens
  misc_feature: GZ8MTXP02HVSUS.22.86.H09.1.454.CMB.2.raw
  modified_base (274)..(274): a, c, t, g, unknown or other
  modified_base (394)..(394): a, c, t, g, unknown or other
  modified_base (396)..(396): a, c, t, g, unknown or other
tcagacatacgcgtcacgaccggtgctcgatttagtgctatagacttgggtttgggctgagcgtggttttccgtcgttagctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggctggagtgggtggcaagttatatggtatgatggaagtaanaaagactatgtgactccgtgaaggccgatcgacatctccagtagacaactccaaagacactctacgtttactaccaatcgaacacgctgagaggcgagacacggcagtgtaattactggngngagagatacgacagtagtaacgtaacggtaagttacgtttagtacgtacgtacggtacgggacggaacggacgtacgtacggtacgtaccgtactacgtacgtacgtaccgtacccgtaccgtaaccggtacccgtaccgtaccgtacccgttccccgtccggtcccgtcccgtccgtccgtaccgacggaccg

SEQ ID NO: 386785 - DNA, 508 bp, Homo sapiens
  misc_feature: GZ8MTXP02JH9YG.22.86.H09.1.454.CMB.2.raw
  modified_base (478)..(478): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcctgggaggtccctgagactctcctgtgcagcgtctggattcaccttcagtggctatggcatgcactggctccgcaggctccgggcaaggggctgggagtggggtgccaattatatggtatgatgggaaagtaataaagactatgtggactcgtgaagggcattcacatctacagagacaactccaaagaacacttctagtttacaccaaatcgaacagcctagagagcgaggacacggcagtgtacttacgngtgcgagagactacgactagtcgtaaacgg

SEQ ID NO: 386786 - DNA, 523 bp, Homo sapiens
  misc_feature: GZ8MTXP02JY48Y.22.86.H09.1.454.CMB.2.raw
  modified_base (373)..(373): a, c, t, g, unknown or other
  modified_base (402)..(402): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtcccctgagactctcctgtgcagcgtctggattcaccttcagtggctatggcatgcactggctccgccaggctccggggcaaggggctgggagtggggtggccaattatatggtatgatgggaaagtaaataaagactangtaggactccgtgaaggccgatccaccanctaccagacgacaaacctccaaagaaccactctgtttacctaccaaatcgaaacacggcctagaagaggcgaaggacgacggcaggtgtatacgtgtcgcgagagatacgacagtgaacgg

SEQ ID NO: 386787 - DNA, 577 bp, Homo sapiens
  misc_feature: GZ8MTXP02GV8QX.22.86.H09.1.454.CMB.2.raw
  modified_base (384)..(384): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactcgtgaggcgatcacatctcagagacaactccaaagacactctcgtttactaccaaatgaacagcctgagaggcgagacacggcagtgtattacgngtggacgagagactcgaacagtagaacgtaaggggaaatcttttaggattctcggtaggggacccaaaggggacacgtcggtacctaccgttctccgttacacgtccctaccaaccgaaaccggggcccctaacgttcccgggtccctttcccccgtggccccgccccgttcggacctcccgaacgggacccg

SEQ ID NO: 386788 - DNA, 503 bp, Homo sapiens
  misc_feature: GZ8MTXP02GI59U.22.86.H09.1.454.CMB.2.raw
  modified_base (327)..(327): a, c, t, g, unknown or other
  modified_base (358)..(358): a, c, t, g, unknown or other
  modified_base (406)..(406): a, c, t, g, unknown or other
  modified_base (411)..(411): a, c, t, g, unknown or other
tcagacatacgcgtcacgaccggtgctcgatttagtgctatagacttgggtttgggggaagaggaagactgacggtcctgccacaggtggtgctgggcacggtgggcactcgacacaacatttgcgctcaactgtcttgtctcaccatggagtttgggctgagcgtgggttttcctcgttgctcttttaagaggtgtccagtgtcaggtgcagctggtggagtctgggggaggcgtggtccagcctggggaggtccctgagctctcctgtgcagcgtctggattcaccttcagtggctatggcatgcatggctcgcaggctccgggnaggggctggagtgggtgcaattatatggtangatggaaagtaataaagctatgtggactcgtagaaggcgatcacatcncaganacactaccaagaacactctgttacacaaatgacagacacgagaggacgaggacgacgacgagtaggtaattacgtacgtgagagagagtacg

SEQ ID NO: 386789 - DNA, 532 bp, Homo sapiens
  misc_feature: GZ8MTXP02HBINS.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggcaattatatggtatgatggaagtaataaagactatgtggactccgtgaagggccgattcaccatctccagagacaactccaaagaacactctcgtttcaccaaatgaacagcctgagaggcgagacacggcagtgtattactgtgcgagagatcgacatgaacgtaacgggaaagtctttagatcgtcgtgggaccaagggacacgtcggtcaccgtctcttcacgcctccacgaacgggcccacgtccggtcctccccgtggccgccctgcctccgacggaccg

SEQ ID NO: 386790 - DNA, 520 bp, Homo sapiens
  misc_feature: GZ8MTXP02I31TG.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcgtctggattcaccttcagtggctatggcatgcactggctccgcaggctccggggcaaggggctgggagtggggtggaccaagttatagtggttatggatggggaaattaaactaaagactatggtggactccgtgaaggccgattcacatctcagagacactacaaagacactctgttactaccaaatcgaaacagaccgtgaggagcgaagggacacgggcagtgtattacgtgtacgcgagagacgtacgacagtacgaacgg

SEQ ID NO: 386791 - DNA, 576 bp, Homo sapiens
  misc_feature: GZ8MTXP02G4MYW.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactcgtgaaggccgattcaccatctccagagacaactccaaagaacactctcgtttcaccaaatgaacagcctgagaggcgaagacacggcagtgtatactgtgcgagagatcgacatgactaacgggaaatctttagatctcgtagggggaccaaaggggacaacgtcgggtaccaacccggttctcctttacgacgtcccctaccgaacccgaaacggggccccctaagttcccgggtccctttccccccgtggaccccgtcccccttggccctacccgaaggacccg

SEQ ID NO: 386792 - DNA, 532 bp, Homo sapiens
  misc_feature: GZ8MTXP02IDBDB.22.86.H09.1.454.CMB.2.raw
  modified_base (261)..(261): a, c, t, g, unknown or other
  modified_base (506)..(506): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggaggtccctgagactctcctgtgcagcgtcnggattcaccttcagtggctatggcatgcactggctcccgccaggcctccggggcaaggggctgggaggtggggtggcctaaattatatgggtatggaatgggaaagtaaaataaagactaatggtgaactccgtaggaaacggccgattcaaccatctaccaagagacaactacccaaagaacacttctcgttactaccaaatagaaacagcctagagaggcgagacacggcagtgtacttacgngtagcgagagatacgacagtagaacg

SEQ ID NO: 386793 - DNA, 596 bp, Homo sapiens
  misc_feature: GZ8MTXP02HURDH.22.86.H09.1.454.CMB.2.raw
  modified_base (275)..(275): a, c, t, g, unknown or other
  modified_base (386)..(386): a, c, t, g, unknown or other
  modified_base (403)..(403): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaaanaaagactatgtggactcgtgaaggccgattcacatctcagagacaactccaaagaacactctcgtttactaccaaaatcgaacagcctggagaaggagacggacgacgggnagtgtaattacgtgtgngaagagactacgacaagtagaacgtaagggggtaaaattcgtttttaggaattcgtcggtacgggggaccaaaggggaacctacgtacgggttcaccgtcttccgttcacggtcctacccgaaccgaacgggcccctagtcccggttcccttcccccgttcggcccgtccccgtgcccgtaccacgggacccg

SEQ ID NO: 386794 - DNA, 544 bp, Homo sapiens
  misc_feature: GZ8MTXP02JA1TJ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcaccatctcagagacaactccaagaacactctcgtttcaccaaatgaacagcctgagaggcgagacaggcagtgtattactgtgacgagagatcgacagtagacgtaacggggaaatcttttagattctcgtggggaccaaggggactacgtggtccaccggttctcttcgacgcctacccaaccgaacgggccctacgtccggttccctcccccgtggcctcccgtgcctccgagaccg

SEQ ID NO: 386795 - DNA, 564 bp, Homo sapiens
  misc_feature: GZ8MTXP02I7599.22.86.H09.1.454.CMB.2.raw
  modified_base (270)..(270): a, c, t, g, unknown or other
  modified_base (277)..(277): a, c, t, g, unknown or other
  modified_base (282)..(284): a, c, t, g, unknown or other
  modified_base (286)..(286): a, c, t, g, unknown or other
  modified_base (289)..(289): a, c, t, g, unknown or other
  modified_base (292)..(292): a, c, t, g, unknown or other
  modified_base (309)..(309): a, c, t, g, unknown or other
  modified_base (311)..(311): a, c, t, g, unknown or other
  modified_base (313)..(313): a, c, t, g, unknown or other
  modified_base (318)..(318): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgtagctctttaagaggtgtcagtgtcaggtgcagctggtggagtcgtgggggagcgtggtccagccgtgggaggtccctgacgctctcctgtgccagcgtctggattcaccttcngtggctntggcnnncncgngcncgcgcgcgcggcgaggngngngtggngcgtatagtagtgtagtagagtagtaagtaaagtaaagtagtagtagtacggtacgtacgtacggtaacggacgtacgtactacctactactacgacgaacgaacaacctaaccaaacgaaacctacttacttacgtttacttaacctaaactaacgaacgacgacgtagacggacggacggacggacgacggacgtagtacgttacgttacgtgtagaagagagacgacgacgacgtacgtaacg

SEQ ID NO: 386796 - DNA, 544 bp, Homo sapiens
  misc_feature: GZ8MTXP02HEXFO.22.86.H09.1.454.CMB.2.raw
  modified_base (310)..(310): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctctgtgcagcgtctggattcacttcagtgctatggcagtgcacgtggctccgcgaggcgtcccgggnaaggggtctggggagtggggtcgacctaagttctagtggtatggatgggaataataagactagtagcggactcgtagacggctatcactatcacagacgacactacaagactctcgtgtacacaatcgaacacgctagacgacggacgtacggacacgggactaggttacgtacgttaccgtggtacgtaacggtaacgacggtacgtacggaaacgtacgtacggtaaaccgg

SEQ ID NO: 386797 - DNA, 542 bp, Homo sapiens
  misc_feature: GZ8MTXP02JQY3W.22.86.H09.1.454.CMB.2.raw
  modified_base (316)..(316): a, c, t, g, unknown or other
tcagacatacgcgtcacgaccggtgctcgatttagtgctatagacttgggtttgggctgagctgggttttcctcgttgctcttttaagaagtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaggcgattcacatctccaganacaactcaaagacactctcgttcaccaaatgaacagcctgagaggcgagacacggcagtgtattactgtgcgagagatcgacagtagacgtaaacgggaaatcgttttagatcttcggtaggggaccaaagggacacgtggtaccaccgtctcttacacgtccctaccaccgtacgggcccacgtccggtccttccccgcggcccgcccgtgccctcgacggaccg

SEQ ID NO: 386798 - DNA, 504 bp, Homo sapiens
  misc_feature: GZ8MTXP02FJKTR.22.86.H09.1.454.CMB.2.raw
tcagacatacgcgtcacgaccggtgctcgatttagtgctatagacttgggtttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttgtgtataactatgtctctgtaccacagcaccaggcaaagcccccagactcatcatttatgctgtcaataagcgcctcgaggggtccccctgatcgcttctctggctccaagtctgcaacacgcctccctgaccatctctgggctccaggctgaagatgaggctgattattactgctgctctatttgcgtaggcgtacctacgtacgtttgggtcgttcgggacggacgggaccaagcgtcgaaccgtcctaggtcacgcccgaacgg

SEQ ID NO: 386799 - DNA, 507 bp, Homo sapiens
  misc_feature: GZ8MTXP02GFC4W.22.86.H09.1.454.CMB.2.raw
  modified_base (340)..(340): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcgtctggattcaccttcagtggctatggcatgcactggctccgccaggctccggggcaaggggctgggagtggggtggccaattntatggtatgatgggaaataaataaagactagtgtagactcgtgaaggcgatcacatctcagagacaactaccaagaacactctgtttactacaaatgaacacgcctgagaggcgaaggacgacggcagtgtacttacgtgtagaacgagagactcgacagtagaacg

SEQ ID NO: 386800 - DNA, 543 bp, Homo sapiens
  misc_feature: GZ8MTXP02H4YLJ.22.86.H09.1.454.CMB.2.raw
  modified_base (381)..(381): a, c, t, g, unknown or other
  modified_base (391)..(391): a, c, t, g, unknown or other
  modified_base (523)..(523): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactaatgtggactccggtgaagggcgattcaccatctccagagacaactccaaagaacactctcgtttctaccaaatgaacagcctgagagcgagacacggnagtgtatacngtgcgagagatgacatagacgtaacgggaatcttttagatctcggtggggaccgaagggactacgtcggtccaccgtctacgttcacgccctaccgacgaacggcccacgttccgtccttccccgtcggccnccctcgcctccgaaggcccg

SEQ ID NO: 386801 - DNA, 540 bp, Homo sapiens
  misc_feature: GZ8MTXP02HDZ03.22.86.H09.1.454.CMB.2.raw
  modified_base (480)..(480): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggggcaaggggctgcaggtgggtgcaattatatggtatgatggaagtaataaagactatgtggactcgtgaagggccgattcaccatctccagagacaactccaaagaacactcctgttcaccaaatgaacacgcctagagaggacgaggacacggcagtgtattactgtgcgagagatacgaacagtagaaacgtaacgggaaagtcgttttagacttcgtcgtcgggaccgaggacacgtggtccacgtctctcncgcctccaccgacggcccacgtccggtccctccccgtcggcctcccgtcgccctcgacgg

SEQ ID NO: 386802 - DNA, 585 bp, Homo sapiens
  misc_feature: GZ8MTXP02HY8R6.22.86.H09.1.454.CMB.2.raw
  modified_base (316)..(316): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggccgtcccggggnaaggggctgggaggtggggtggctaatttatgtggtatggatggggaaataaactaaagacttagtgtggacctccgtaggaaaggggccctattccacccgtatcctaccagacgaacaactacccaaaagacctacttccttagttttacccaccgaaaatcgaaaactcgccctaggaaggacgggacgaacgggaccctaggggactaagggttcgttaattaccgtggagaacgaagacgtactacgaactacgtacgaaacgg

SEQ ID NO: 386803 - DNA, 641 bp, Homo sapiens
  misc_feature: GZ8MTXP02GI2TD.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcagtgcacgtcggcctcccgccgaggccgtcccggggacgaagggggctggggacggtggggtggacctaagttagtagtggtatggaagtaggggaaattaaagtaaaagacttaagtggtaggaacccgttccggtaggaaacgggtcccgtaagttaccaaccctatcctaccgaaggaacgaaaccaaacctaacccgaaacgtaaacctacctttactacgttttaccaaccaaaacgtacgaaacgacgtacccgtaggaacggacgggacggaacggaaccgacggactaaggtcgttaacttacgtggtacgcggaaggtacgactacgaactagtacggtaaaccgg

SEQ ID NO: 386804 - DNA, 565 bp, Homo sapiens
  misc_feature: GZ8MTXP02HM0YW.22.86.H09.1.454.CMB.2.raw
  modified_base (391)..(391): a, c, t, g, unknown or other
  modified_base (409)..(409): a, c, t, g, unknown or other
  modified_base (537)..(537): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaaagaacactctcgtttcaccaaaatgaacacgcctgagaggcgaggacacggcagtgtattacngtgcgtagagatcgacanagacgtaacgggaaatcttttaggaattcgtcggtggggaccgtaaaggggacacgtggtaccacccgtctaccttcgacgtccctaccaccgaaacggggcccctacgttcccggtccttcccccgnggcccgtccctcggcctccgacggaccg

SEQ ID NO: 386805 - DNA, 574 bp, Homo sapiens
  misc_feature: GZ8MTXP02IXYSH.22.86.H09.1.454.CMB.2.raw
  modified_base (316)..(316): a, c, t, g, unknown or other
  modified_base (373)..(373): a, c, t, g, unknown or other
  modified_base (384)..(384): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtaggactccgtgaaggcgatcacatctcaganacaactccaaagaacatctcgttactacaaatgaacagctgagaggcgagacacggnagtgtattacngtagacgagagactcgacagtacgaacgtaaacggggaaattctttaggattcgtcggtagggggaccaaaggggacaacgttcgggtacctaccggtctacgttcaacgtcccacccgaaaccgaaacgggcccctaagttcccggtcccttccccggtgacccgtcccctggccctaccgaacggccg

SEQ ID NO: 386806 - DNA, 787 bp, Homo sapiens
  misc_feature: GZ8MTXP02JAYQV.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctccgtgtgcaggcgtctggattccaccttcagtggctagtggcagtgcactggcctcccgccgagggccgtcccggggcgaagggggcctggggaggtggggtcggaccctaaagtttagtagtaggggttatggaagtagggggtaaaagttaaaacgtaaaaaggtaccttaagttgggttacgggtaacccgttacccgggttagggaaaacgggggtacccggtaaactttacccgaaacccgtaacttacccgttacccgaaacggtaaaccggaaaccctaaaacccttaacccgaaaaccggtaaaacctaacccgtttaccctttacggtttttaacccttaaacccgtaaaattaacggaaaccgaacggtacccgttagggaaagggaacggggaccggaaacggggaaccgaaccggggaccgtaaggggttaacggtttaacgtttaaaccggttggttaacgggtaaccggtaaacgggaacggtaacggttaccggaaaccgtaacggttaacgggtaaaacccgggg

SEQ ID NO: 386807 - DNA, 501 bp, Homo sapiens
  misc_feature: GZ8MTXP02J3KRV.22.86.H09.1.454.CMB.2.raw
  modified_base (340)..(340): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtcccctgagactctcctgtgcagcgtctggattcacccttcagtggctatggcatgcactggctccgccaggctccgggcaggggctggagtgggtgccaatttanatggtatgatgggaagtaaataaagctatgtggactcgtgaaggccgattcacatctccagagacaactaccaagaacactctgtttactaccaaatagaacagcctgagaggcgaggacacggcagtgtatacgtgtgcgagagatacgacatcgaacgg

SEQ ID NO: 386808 - DNA, 677 bp, Homo sapiens
  misc_feature: GZ8MTXP02FZ5CX.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggcctccggggcaagggggctggggaggtggggtggacctaaagtttagtagtggggttaattggaagtttaggggaaaagttaaaataaaacggactttaagttgggttacggggaacccttacccgggttaggaaacgggggtcccgaaagtttacccaaccctaatcctacccgaaaggaacggaaaccaaaccttacccgaaaagaaaccctaaccgtttccttacgttttacccttaacccaaaattacggaaacacgtaccctaggaaggacgggacgaacgggaccaaacggggtctaaggttacgttaacgtttaacgtggttgaaccggaaggacggaattaccggaaaactaacgtacggtaacgg

SEQ ID NO: 386809 - DNA, 517 bp, Homo sapiens
  misc_feature: GZ8MTXP02F9JI5.22.86.H09.1.454.CMB.2.raw
  modified_base (491)..(491): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctggggaggtccctgagactctcctgtgcagcgtctggattcaccttcagtggctatggcatgcactggctccgccaggctcccggggcaaggggctgggaggtggggtggccaattatagtggtatggatgggaaataaataaagactatgtaggactccgtagaagggccgattcaccatctccagagacaactaccaaagaaccactctgtttacaccaaatgaacagcctagagaggcgaggacacggcagtgtacttacgngtagcgagagatcgacactagtaacg

SEQ ID NO: 386810 - DNA, 536 bp, Homo sapiens
  misc_feature: GZ8MTXP02FHTSR.22.86.H09.1.454.CMB.2.raw
  modified_base (254)..(254): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattanatggtatgatggaagtaataaagactatgtggactcgtgaaggccgattcacatctccagagacaactccaaagaacactctcgtttctaccaaaatgaaacagcctgagaggcgaggacacggcagtgtattactgtgcgagagatcgacatagacgtaacgggaaagtacttttgattctacgtggggacccgaaaggggacacgtcggtacaccgtctcttcagccctcaccaacgggcccacgtcggtcctccccgtggccgccctgacctccaggac

SEQ ID NO: 386811 - DNA, 569 bp, Homo sapiens
  misc_feature: GZ8MTXP02I30KS.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgtgaaggccgattcaccatctccagagacaactccaaagacactctgtttcaccaaatgaacagcctgagaggcgagacacggcagtgtattactgtgcgagagatcgacagtgaacgtacggggaaatcgttttagattccgtgtacgggggaccctaaaggggaccacgtgggtccaaccgttctcttcgacgtccctacccgaaccgaacgggccctaacgttcccggttcccttcccccgtcggcccgcccccgtctcccgacggacaccccg

SEQ ID NO: 386812 - DNA, 486 bp, Homo sapiens
  misc_feature: GZ8MTXP02I0J2Z.22.86.H09.1.454.CMB.2.raw
  modified_base (238)..(238): a, c, t, g, unknown or other
  modified_base (325)..(325): a, c, t, g, unknown or other
  modified_base (331)..(331): a, c, t, g, unknown or other
  modified_base (344)..(344): a, c, t, g, unknown or other
  modified_base (367)..(367): a, c, t, g, unknown or other
  modified_base (401)..(401): a, c, t, g, unknown or other
  modified_base (406)..(406): a, c, t, g, unknown or other
  modified_base (482)..(482): a, c, t, g, unknown or other
  modified_base (484)..(484): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttatactatgtctcctggtaccanagcacccaggcaaagccccagctcatcatttatgctgtcaataagcggccctcaggggtccctgatcgcttctctggctccaagtcnggcacncgcctcctgaccntctctgggctccgaggctgaagntgaggctgattattactgctgctcattgcaggcncctanacgttggtgtcggcggaggccaagctgaccgtcagtcagcccaggcctgccccctggtcacttcgtccgcccttcncncg

SEQ ID NO: 386813 - DNA, 553 bp, Homo sapiens
  misc_feature: GZ8MTXP02GBYT4.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcactggcctccgccgaggccgtccggggcaagggggctggggaggtggggtgacctaattatagtggtatgaatgggaaataataaagactatgtggactcgtagaacggccgtattcacctatctaccaagacgacaactaccaaacgaactacctcttcgtttacctaccaaatgaacacgacctagacgaggcggaaggaccgacggactaggtagttactacgtgtagaacggaagacgagtacgactagtacgtaaacgg

SEQ ID NO: 386814 - DNA, 595 bp, Homo sapiens
  misc_feature: GZ8MTXP02G7AEQ.22.86.H09.1.454.CMB.2.raw
  modified_base (377)..(377): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctggagtgggtggcaattatatggtatgatggaataataaagactatgtggactccgtgaaggccgatcaccatctccagagacaactcaaagacactctcgttacaccaaatgaacagcctgagaggcgagacacggcagtntattactgtagcgagagagtacgaacagtacggaacgtaaacgggggaaatcgtttttagaacttccgtcgggtacggggacctaaagggggacctacgtgggtcctaacccggttcttccgttacaccgtaccctccccgaaaccgaaacggggtcccctaagtcccggttaccccttcccccgtggcccgtccccttcgccctacccgaggacccg

SEQ ID NO: 386815 - DNA, 542 bp, Homo sapiens
  misc_feature: GZ8MTXP02HZLT5.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcgtccgggcgaaggggctgggaggtggggtgcctaattatagtggtatggaatggggaaagtaaataaagactaatggtaggacctccgtagaacgggccgattcaccatcctccagacgacaactaccaaagaaccacttacttcgtttacctaccaaatcgaaacacggcctaggagaggcgacggacacggcaggtatagtacgtgtcgaagagagacgtcgacgagtagaacgg

SEQ ID NO: 386816 - DNA, 548 bp, Homo sapiens
  misc_feature: GZ8MTXP02HNYNS.22.86.H09.1.454.CMB.2.raw
  modified_base (244)..(244): a, c, t, g, unknown or other
  modified_base (281)..(281): a, c, t, g, unknown or other
  modified_base (369)..(369): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttaataactatgtctcctggtaccaacngcacccaggccaaacgcccccagactcatctatttangctgtacaataacgcggccctcgacggggtccctgatccgctttctctggcctaccaagtctcggacaaccacgccctccctgacctntcctcgtcgggcctccgaggctagaagatgagctagtattatactgctgctctatttgctacggcacctacgtacgttgggtcgttcgggcggaggaccgaagcgtacgaccgtcgtacgtcacgacccacgcctccgccccgtcggtctaccgtccttccgtccccacctttccaccg

SEQ ID NO: 386817 - DNA, 501 bp, Homo sapiens
  misc_feature: GZ8MTXP02FT027.22.86.H09.1.454.CMB.2.raw
  modified_base (342)..(342): a, c, t, g, unknown or other
  modified_base (475)..(475): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggaggtccctgagactctcctgtgcagcgtctggattcaccttcagtggctatggcatgcactggctccgcaggctcccggggcaaggggctgggagtggggtgaccaattnagtggtatgatgggaaataataaagactatgtgactcgtgaaggcgatcacatcctacagagacaactaccaaagaacactctgttacctacaaatgaaacagctgagaggcaggacaggcagtgtattacgngtgaagagagacacgacactagaacg

SEQ ID NO: 386818 - DNA, 552 bp, Homo sapiens
  misc_feature: GZ8MTXP02FQSVI.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactcgtgaaggccgatcacatctccagagacaactccaaagaacactctacgtttctaccaaatgaacagcctgagaggcgagacacggcagtgtattactgtagcgagagatcgacatagactaacggggaaatctttagatctcgtaggggacccaagggtacacgtcggcctaccggtctcttacacgtccctaccaaccgaacgggcccctagtcccggttcccttcccccgtggcccgccctcggacctcccgagggaccg

SEQ ID NO: 386819 - DNA, 546 bp, Homo sapiens
  misc_feature: GZ8MTXP02H2A0X.22.86.H09.1.454.CMB.2.raw
  modified_base (519)..(519): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaaagtaataaagactatgtggactccgtgaagggcgattcaccatctccagagacaactccaaagaacactctcgtttactaccaaatcgaacagcctgagaggcgaggacacggcagtgtatacgtgtgcgagagatcgacatgacgtaacgggaatcgttttgatcgtcgtgggaccgaagggactacgtggtccaccgtctcttcacgtccctaccaaccgaacgggtcccacttccggtcctttcccccgnggcccgtccctcgcctccgacggaccg

SEQ ID NO: 386820 - DNA, 599 bp, Homo sapiens
  misc_feature: GZ8MTXP02J2GRL.22.86.H09.1.454.CMB.2.raw
  modified_base (357)..(357): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagctctcctgtgcagcgtctggattcaccttcagtggctagtggcagtgcacgtggcctccgccgaggcctccgaggtcggagggcgtggaggtgggtcgactaagtagtagtggtanaggtagtaagggaaaacttaaagtaacgtagttagttcgggtacggtaccgttacgggtaaggaacccgggtactactacccacgtagtccacgaaggacaaaccacctaacgaaacactaccttgttacttacaactaagacgacgtacgcgaggacggacggacgacggaccgtacggacttaggtacgtacgtttagacggaaggacggtaggaccttagaccggaactaggtaaacgg

SEQ ID NO: 386821 - DNA, 537 bp, Homo sapiens
  misc_feature: GZ8MTXP02HS53P.22.86.H09.1.454.CMB.2.raw
  modified_base (271)..(271): a, c, t, g, unknown or other
  modified_base (513)..(513): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgacgttggtgttataactatgtctctgtaccaacaacacccaggcaaagccccaaatcatgattangagtcactaagccggccctgaggggtccctgatcgcttctctgctcagtctgcaacgccgccctcctgaccgtctcgtcggctccgaggctgagatggaggtctgtattattactgtcttactctatatgcgaggcggactacgttgttggggtcgttcgggcgggagggacagctcggaccgtcgtagtcacgccgaacggtcctccgcccccgtacggtcctaccgtcctccgttccccnccctcctccacgtccgtatcgtcg

SEQ ID NO: 386822 - DNA, 574 bp, Homo sapiens
  misc_feature: GZ8MTXP02IWJ3H.22.86.H09.1.454.CMB.2.raw
  modified_base (380)..(380): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctcgcaggctcgggcaagggctggagtgggtggcaattatatggtatgatggaaagtaataagactatgtgactccgtgaaggccgatcacatctccagacgacaactaccaaagaaccacttctcgtttactaccaaaatgaacagcctgagaggcgagacacggcagtntattactgtgacgaagagatcgaacatagaacgtaaacgggaaagttctttagatcgtcgtaggggaccaagggacacgtggtaccaccgtcgtacttacgaccgccctacccgaaccgaacgggtcccccaacgttccccgttcccttcccccgtcgggcccgtcccccgtcgcccgttacccgacggacccg

SEQ ID NO: 386823 - DNA, 514 bp, Homo sapiens
  misc_feature: GZ8MTXP02IYGLF.22.86.H09.1.454.CMB.2.raw
  modified_base (227)..(227): a, c, t, g, unknown or other
  modified_base (252)..(252): a, c, t, g, unknown or other
  modified_base (341)..(341): a, c, t, g, unknown or other
  modified_base (499)..(499): a, c, t, g, unknown or other
  modified_base (503)..(503): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattnatggtatgatggaagtaataaagactaatgtggactccgtgaaggccgattcaccatctccagagacaactccaagacactctgtttcnccaaatgaacagcctgagaggcgagacagggcagtgtattactgtgcgagagatcgacatgaacgtaacgggaaaagtcttttgattctcgtgggggacccaagggacaacgtggtcaccgtctcttcagccctcaccaacggccactcgtctcccgngccncctgctcagcg

SEQ ID NO: 386824 - DNA, 569 bp, Homo sapiens
  misc_feature: GZ8MTXP02GSUK6.22.86.H09.1.454.CMB.2.raw
  modified_base (212)..(212): a, c, t, g, unknown or other
  modified_base (223)..(223): a, c, t, g, unknown or other
  modified_base (254)..(254): a, c, t, g, unknown or other
  modified_base (271)..(271): a, c, t, g, unknown or other
  modified_base (275)..(275): a, c, t, g, unknown or other
  modified_base (280)..(280): a, c, t, g, unknown or other
  modified_base (285)..(285): a, c, t, g, unknown or other
  modified_base (310)..(310): a, c, t, g, unknown or other
  modified_base (315)..(315): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagttttgggctgagcgtggttttcgcgtaggctcttttaagaggtgtccagtgtcaggtgcagctggtggagtctgggggnggcgtggtcgngcgtgggaggtccgtgagactctctgtgcgngcgtcgtgatctactcngtgntatgnatgcncgtgctccgcgcgcgccggcgaggngtggnggtggtggacgtagttatagtagtagtagtagtaggtaaagtaaagtaaagtaatagtagtaggtacgtacgtaggtaacggacgtactacgacctactacctacgagaacgaactaacctaaccgaaacgaaacctacttacttacgtttacctaaccgtaaacgtaacgaacgaacgacgtagagaggacggacggacgacgacgagtacgtacgtacgtagtgaagagacgacgtacgacgacgtacgacg

SEQ ID NO: 386825 - DNA, 522 bp, Homo sapiens
  misc_feature: GZ8MTXP02JHY88.22.86.H09.1.454.CMB.2.raw
  modified_base (454)..(454): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcagtggctagtggcatgcactggctccgccaggcctccggggcgaaggggctgggaggtggggtggaccaattatagtggtatgataggggaaagtaaataaagactagtgtggactcgtgaggcgatcaccatctcagagacaactaccaagaacactcttgttacctaccaaatacgaacncgaccgtgagaggacgacggacgacggcagtacgtagttactgtgcgagagactcgacagtagaacgg

SEQ ID NO: 386826 - DNA, 582 bp, Homo sapiens
  misc_feature: GZ8MTXP02INUXI.22.86.H09.1.454.CMB.2.raw
  modified_base (261)..(261): a, c, t, g, unknown or other
  modified_base (276)..(276): a, c, t, g, unknown or other
  modified_base (278)..(278): a, c, t, g, unknown or other
  modified_base (281)..(283): a, c, t, g, unknown or other
  modified_base (286)..(286): a, c, t, g, unknown or other
  modified_base (310)..(310): a, c, t, g, unknown or other
  modified_base (312)..(312): a, c, t, g, unknown or other
  modified_base (314)..(314): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggttttcgcgtagcgtcttttaagaggtgtcagtgtcaggtgcagctggtggagtcgtgggggagcgtggtccagcctgggaggtccctgagctctcctgtgccagcgtctggntcaccttccagtggntntgnnngcncgcgcgccgcgcgcgcggcgaggngngnggtggtggcgtatagtagtagtagtagtagtagtaaagtaaagtaaagtaagtagtaggtacggtacgtaccgtacggtaacggaccgtacgtacacctactacctaccgaacgaacgaaccaacctaaccaaacgaaacctaacgttacttacgtttacctaacctaaacgtaacgaacgaacgacgtacggacgacggacggacggacgacggacgtagtacgtacgttacgtgtgaacgagacgacgacgacgacgtacgtaacg

SEQ ID NO: 386827 - DNA, 662 bp, Homo sapiens
  misc_feature: GZ8MTXP02G9OX5.22.86.H09.1.454.CMB.2.raw
  modified_base (217)..(217): a, c, t, g, unknown or other
  modified_base (261)..(261): a, c, t, g, unknown or other
  modified_base (265)..(265): a, c, t, g, unknown or other
  modified_base (444)..(444): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactntgtctcctgtaccaacacaccagccaaacccccatcatcattanggtntcactcgtcggccctcaggagtctctcatcgcttctcaggtctccaagtctggacaaccgaccggccccctaccctaaccactcctcgttcgggccttccgagtttgggggacgtacgtacgttaccttaactttacgttaactgtaccttaacgtttacctttaaaagtcgggtaccnccctaacttcccgttcggttcgggtttttccgggacgggtaacggtccgtaacccgggtaaagtccggtacccggttccgtccgggttaccaccggtacccgaaaggttccctacccggtcccccgtcgggtacctacccgttcctcccggtttacccccacccttccgtaccgtaccgtacgttaagtcgtcgtcggacggtccggtacgtcggacg

SEQ ID NO: 386828 - DNA, 547 bp, Homo sapiens
  misc_feature: GZ8MTXP02H3GSZ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaagttatatggtatgatggaaagtaataaagactatgtggactccgtgaagggccgattcaccatctccagagacaactccaaagaaccactctcgtttctaccaaatgaacagcctgagaggcgagacacggcagtgtatactgtgcgagagatcgacatgactaacggggaaagtcttttgatctacgtggggccaaaggggacacgtggtccacgtctacttcacgtccctaccaccgaacgggcccacgttccggtccttcccccgtggcccgccctggcccttccgaacggccg

SEQ ID NO: 386829 - DNA, 647 bp, Homo sapiens
  misc_feature: GZ8MTXP02JQ3SH.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgtgaagggccattcaccatctccagagacaactccaaagacactctcgttactaccaaatgaacagcctgagaggcgagacacggcagtgtattacgtgtgacgagagatacggacagtagaacgtaaacggggaaagttcgttttagaacttcgtacggttagggggacccgaaagggggacctaaccgttcggggttacctaacccggttccttacccgtttaccgaaccggtccccgttaccccgaaacccgaaaccgggggtccccctaacggtttccccgggttacccttcccccccggttgggcccccggtcccccgtacgtccccgttacccggaacgggtaaccccg

SEQ ID NO: 386830 - DNA, 532 bp, Homo sapiens
  misc_feature: GZ8MTXP02JYAOB.22.86.H09.1.454.CMB.2.raw
  modified_base (509)..(509): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaggccgattcacatctccagagacaactccaaagaacactctcgtttctaccaaatgaacagcctgagaggcgaggacacggcagtgtattactgtgcgagagatcgacatgacgtaacgggaaatcttttagattctcgtggggaccaaggggacacgtggtccaccgtctcttcacgccctccaccgacggcccacgtccggtcctcccccgnggcccgccctgcctccgaggccg

SEQ ID NO: 386831 - DNA, 505 bp, Homo sapiens
  misc_feature: GZ8MTXP02ITOVU.22.86.H09.1.454.CMB.2.raw
  modified_base (230)..(230): a, c, t, g, unknown or other
  modified_base (263)..(263): a, c, t, g, unknown or other
  modified_base (331)..(331): a, c, t, g, unknown or other
  modified_base (338)..(338): a, c, t, g, unknown or other
  modified_base (356)..(356): a, c, t, g, unknown or other
  modified_base (490)..(490): a, c, t, g, unknown or other
tcagacatacgcgtcacgaccggtgctcgatttagtgctatagacttgggtttggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccacngcaccaggcaaagcccccagactcatcatttangctgtcaataagcggccctcaggggtccctgatcgcttctctggctccaagtctggcacacgcctccngacatcnctgggctccagctgaagntgagctgattattactgctgctcatttgcaggcgccttacacgtttgggtcgttcggcggtagggaccaaggcgtgaccgtcgtacggtcacgtccaaaggctacgccccgtcggtccaacgtcctcgttcccnccctcctccacgtcg

SEQ ID NO: 386832 - DNA, 593 bp, Homo sapiens
  misc_feature: GZ8MTXP02IT7JF.22.86.H09.1.454.CMB.2.raw
  modified_base (384)..(384): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaagttatatggtatgatggaagtaataaagactatgtggactccgtgaggcgatcacatctcagagacaactccaaagacactctcgtttcaccaaatgaacagcctgaagaggcgaggacacggcagtgtattacngtgcgagagatacgaacagtagaacgtaacgggaaagttactttaggaattctcggtacggggaccgaagggacacgtcggtacctaccgtctcctttcgacgtcccgttacccaacccgaaacggggcccctaaacgttcccggttcccgtttccccccgtcggggtccccgtcccccgtacggtcccttacccgacggggaaccccg

SEQ ID NO: 386833 - DNA, 504 bp, Homo sapiens
  misc_feature: GZ8MTXP02F3P53.22.86.H09.1.454.CMB.2.raw
  modified_base (479)..(479): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcctgtgcagcgtctggattcaccttcagtggctatggcatgcactggctccgcaggcctccggggcaaggggctggagtggggtggccaattatatggtatgatgggaaataataaagctatggtggactccgtgaaggccgattcaccatctccagagacaactaccaaagacactctgtttacaccaaatgaacagcctagacgaggcgaggacacggcagtgtacttacgngtagcgagagactcgacatcgaacg

SEQ ID NO: 386834 - DNA, 624 bp, Homo sapiens
  misc_feature: GZ8MTXP02JUGLD.22.86.H09.1.454.CMB.2.raw
  modified_base (228)..(228): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaagtaataaagactatgtggactccgtgaaggccgattcacatctccagagacaactccaaagaacactctgtttcaccaaatgaacagcctgagaggcgaggacacggcagtgtattacgtgtgcgagagatcgacatagacgtaacggggaaagttcgttttagacgttcgtacggttacgggggaccgaaaggggtacctacggttcgggtaccctaacccggttcttaccctttccgaacggtccccttacccgaacccggtaaacggggccccctaacgttccccggttcccctttccccccggtcgggtccccgtcccccgtcggtaccccttcccggaacgggtaccccgg

SEQ ID NO: 386835 - DNA, 527 bp, Homo sapiens
  misc_feature: GZ8MTXP02G6HOH.22.86.H09.1.454.CMB.2.raw
  modified_base (462)..(462): a, c, t, g, unknown or other
  modified_base (504)..(504): a, c, t, g, unknown or other
  modified_base (509)..(509): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggcgattcaccatctccagagacaactccaaagaacactctgtttctaccaaatgaacagcctgagaggcgagacacggcagtgtattactgtgcgagagatcgaacatgaactaacggggaaatctttagatctcgtaggggaccaagggacacgtggtcaccgtntcgtcacgcctccacgaacggcccagtccggtccttccccgnggccnccctgcctccgaggtccg

SEQ ID NO: 386836 - DNA, 583 bp, Homo sapiens
  misc_feature: GZ8MTXP02FRURB.22.86.H09.1.454.CMB.2.raw
  modified_base (239)..(239): a, c, t, g, unknown or other
  modified_base (271)..(271): a, c, t, g, unknown or other
  modified_base (323)..(323): a, c, t, g, unknown or other
  modified_base (346)..(346): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcaccatcctcctacactggaaccagcagtgatgttggtgttataactatgtctctgtaccaangcaccaggcaaacgccccagactcatcattangctgtacaataagccgccctcgaggggtccctgatcgctctctgctcagtcncggacaacgcgcctcctgacctntctcgtggcctccgaggtctagaacgagtgacgctgtaatttactactgtctgtactctagtttcgacgtacgggcctccgttaacgtacgttcggggttcggtccgggacgggaacgggaccaaaggtcccgtacggtaacccggttccgtaagggtcccaacggtacccggaacgtcccgtccgtcccccgtcggtaccctaccgttcctccgttccccctaccctccttacccg

SEQ ID NO: 386837 - DNA, 533 bp, Homo sapiens
  misc_feature: GZ8MTXP02I7ZOP.22.86.H09.1.454.CMB.2.raw
  modified_base (384)..(384): a, c, t, g, unknown or other
  modified_base (506)..(506): a, c, t, g, unknown or other
  modified_base (513)..(513): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaagggctggagtgggtggcaattatatggtatgatggaaagtaataaagactatgtggactccgtgaaggccgattcacatctcagagacaactccaaagacactctgtttcaccaaatgaacagcctgagaggcgaggacacggcagtgtattacngtgcgagagatcgacatagacttaacggggaaatcttttagatctgtcggggaccaaggggacacgtggtcaccgtctcttcagcctccgacgaacggccctacgtccggtccttcccccgnggccccncccgtcgcctaccgacggcg

SEQ ID NO: 386838 - DNA, 609 bp, Homo sapiens
  misc_feature: GZ8MTXP02HA3TN.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgcactggcctcccgccgaggccgtcccggggcgaaggggcctggggaggtcggggtggcctaaagttagtagtggtatggataggggaaagttaaataaagacttaagtggtaggaccgtccgtaggaacggggccgtagttccaacccattcctaccgaagaacgaaccaacctaccaaagtaaacctaccgttacttcgtttacctaacctaaatacgaaacacgtccgtaggaagacgggacggaacggacgaccgggactaaggtagttacgttacgtggtgaacggaagagtactacggactagtacggtaaaccgg

SEQ ID NO: 386839 - DNA, 529 bp, Homo sapiens
  misc_feature: GZ8MTXP02FXAKN.22.86.H09.1.454.CMB.2.raw
  modified_base (388)..(388): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtgactccgtgaaggccgatcacatctccagagacaactaccaaagaacactctcgtttctaccaaatgaacagcctgagaggcgaggacacggcagtgtattacgngtgcgagagatcgacatagactaacggggaaatctttagattctacgtgggaccgaaggcacgtcggtcaccgtctcttacacgcctccacgaacggcccactccgtccttccccgcgtccgccctggcctccgacgaccg

SEQ ID NO: 386840 - DNA, 516 bp, Homo sapiens
  misc_feature: GZ8MTXP02I6HYH.22.86.H09.1.454.CMB.2.raw
  modified_base (273)..(273): a, c, t, g, unknown or other
  modified_base (341)..(341): a, c, t, g, unknown or other
  modified_base (401)..(401): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttggggctgagctgggttttcctcgttgctcttttaagaggtgtccagtgtcaggtgcagctggtggagtcgtgggggaggcgtggtccagcctggggaggtccctgagactctcctgtgcagcgtctggattcacttnagtgctatggcatgcactggctccgccaggcctccgggcaaggggctgggagtgggtggaccaattanatggtatgatgggaaataataaagatagtgtggactcgtagaaggccgattcaccatccncagacgacaactaccaagaacacttctgttacctaccaaatgaacagcctgagagcgaggacacgggtacagtacgtattacgtgaggcgagacgtactacgacgagtacgaacg

SEQ ID NO: 386841 - DNA, 523 bp, Homo sapiens
  misc_feature: GZ8MTXP02GF86H.22.86.H09.1.454.CMB.2.raw
  modified_base (502)..(502): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtgactcgtgaaggccgattcaccatctccagagacaactccaaagaacactctcgtttcaccaaatgaacagcctgagaggcgagacacggcagtgtattactgtgcgagagatcgacatagactaacgggaaatcttttagattcgtcgtggggacctaagggacacgtgtacacgtctctcacgcctccacgacggcccacgtccggtcctccccgngccgccctgcctcgacgaccg

SEQ ID NO: 386842 - DNA, 522 bp, Homo sapiens
  misc_feature: GZ8MTXP02GD95F.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgccaggctccggggcaaggggctgggagtggggtggccaattatagtggtatgatgggaaagtaaataaagctatgtcggactccgtagaaggccgaattcaccatctacagagacaactaccaaagaacactctcgtttacctaccaaaatgaaacagacctgagaggcgaggacgacggcagtcgtattacgtgtagcgaagagtacacgacagtacgaacg

SEQ ID NO: 386843 - DNA, 547 bp, Homo sapiens
  misc_feature: GZ8MTXP02F9DW6.22.86.H09.1.454.CMB.2.raw
  modified_base (396)..(396): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaggccgattcaccatctccagagacaactccaaagacactctgtttctaccaaatgaacagcctgagaggcgagacacggcagtgtattactgtgcgaganatcgacatgactaacgggaaatcttttagatctacgtggggaccaagggacacgtggccacgtctcgttcacgccctccaccgaaacgggccctaacgtcccggttcccttcccccgtcggcccgtcccccttgccctcccgagggacccg

SEQ ID NO: 386844 - DNA, 571 bp, Homo sapiens
  misc_feature: GZ8MTXP02JG6NF.22.86.H09.1.454.CMB.2.raw
  modified_base (344)..(344): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcagtggctatggcatgcacgtggctccgcaggcctccggggcgaaggggctgggaggtggggtgacctaattntagtggtatgagtgggaaagttaaacaaaggtactaagtgtaggacgtccgtagaaacgggccgattccaccattccaccgaagacgacaactaccgaaagaacctactcttacgtttccaacccaaagtcgaaacagcctaggacgaacgggcggaacggaccgacgggactaggtacgttattacgtggtagaacggaagagactacggactagtagtaaaccgg

SEQ ID NO: 386845 - DNA, 513 bp, Homo sapiens
  misc_feature: GZ8MTXP02FVFC9.22.86.H09.1.454.CMB.2.raw
  modified_base (399)..(399): a, c, t, g, unknown or other
  modified_base (415)..(415): a, c, t, g, unknown or other
tcagacatacgcgtcacgaccggtgctcgatttagtgctatagacttgggtttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaacagcacccaggcaaagccccagactcatcatttatgctgtcaataagcggcctcgaggggtccccctgatcgcttctctggctccaagtctgcaacacggcctcctgacccatctctgggctccaggctgaacgntgagctgattattacngctgctctattgctaggcgcctacgacgtttgggtgttcgggcggaacgggacccaaaggcgtcggaacccgtcgtacggtccacggtccccaaaggg

SEQ ID NO: 386846 - DNA, 619 bp, Homo sapiens
  misc_feature: GZ8MTXP02F4LUC.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcacatctcagagacaactccaaagacactctgtttcaccaaatgaacagcctgagaggcgaggacacggcagtgtattactgtgcgagagatcgacatacgaacgtaaacggggaaaattcgttttaggaattccgtacggtacgggggacccgaaaggggacctaacgttcgggtcctaaccggttcctacgtttaccaacggtcccctacccgaaacccgaaacggggccccctaacgttcccggttaccccgtttccccccgtcgggtccccgtcccccgtcgggtcccctacccggaacggggtaaccccg

SEQ ID NO: 386847 - DNA, 511 bp, Homo sapiens
  misc_feature: GZ8MTXP02GGZLJ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgccaggctccggggcaggggctgggagtggggtgcaattatatggtatgatgggaaataataaagactatgtagactcgtgaagggccattcaccatctacagagacaactccaaagaacactctagtttacaccaaatgaacagcctagagaggcgaaggacacggcaggtgtacttacgtgtgaacgagagactacgacagtacgtaacgg

SEQ ID NO: 386848 - DNA, 508 bp, Homo sapiens
  misc_feature: GZ8MTXP02I0UT2.22.86.H09.1.454.CMB.2.raw
  modified_base (302)..(302): a, c, t, g, unknown or other
  modified_base (379)..(379): a, c, t, g, unknown or other
  modified_base (398)..(398): a, c, t, g, unknown or other
  modified_base (421)..(421): a, c, t, g, unknown or other
tcagacatacgcgtcacgaccggtgctcgatttagtgctatagacttgggtttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccaggcaaacgccccagactcatcatttangctgtcaataagcgccctgacggggtccccctgatcgcttctctgctcaagtctgcaacacgcctccctgaccatcnctggctccaggctagaagntgagctgattatactgctgcttntattgacgcgctaccgtacgtacggttcgggtcggtcggacggacggaccaagcgtacgaccgtaccgtaggccgacgaccgtaacg

SEQ ID NO: 386849 - DNA, 562 bp, Homo sapiens
  misc_feature: GZ8MTXP02G89PR.22.86.H09.1.454.CMB.2.raw
  modified_base (425)..(425): a, c, t, g, unknown or other
  modified_base (535)..(535): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctcgtttcaccaaatcgaacagcctgagaggcgagacacggcagtagtattactgtgcgagagatcgaacagtagacgtaacgggaaatnttttagatcttcgtaggggacccaaaggggcaacgtggtaccaccggttctcctttacgacgccctacccgaccgaaacgggtccccaacgtcccggttccttcccccgnggcccgcccttggcctccgacggaccg

SEQ ID NO: 386850 - DNA, 577 bp, Homo sapiens
  misc_feature: GZ8MTXP02GQY2C.22.86.H09.1.454.CMB.2.raw
  modified_base (226)..(226): a, c, t, g, unknown or other
  modified_base (252)..(252): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctggagtgggtggcaattanatggtatgatggaagtaataaagactatgtggactccgtagaagggccgattcaccatctaccagacgacaactccaaagaacactctacgttcaccaaatgaacagcctgagaggcgaggacacggcagtcgtattactgtgacgagagatcgaacatacggaacgtaaacggggaattcttttagactctacggtagggaccgaaagggacacgtcggtccgaccgtctccttcacgccctaccaaccgaaccgggtcccacgttcccggtaccttccccccgtgggtccccgtcccctcggtccctaccgacggggtacccg

SEQ ID NO: 386851 - DNA, 697 bp, Homo sapiens
  misc_feature: GZ8MTXP02JP2KU.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagctctcctgtgcagcgtctggacttccaccttcagtggctagtggcatgcacgtcggcctcccggcgacgggccgtcccggggacgaagggggtctaggggacggtggggtggacctaaatttagtaagtggtaatgaagtagggaaaagttaaactaaaaggtacttaagtggtacgggtaacccgttacccgggtaggaaacggggtccctaagtttcccaaccctaactcccgtaccgaacggaacgaaccaaaccgttaacccaaagtaaacctaccttcgttacgttttaccctaaaccgaaaagttcgaaaacctacgaccgttaggaaacggacgggaccggaaagggaacccgacggggtactaaggttacgttaacgtttaaccggttggtaccgaacggaggaacggtacgtacccggaaactacggtttacgggtaaaacccggg

SEQ ID NO: 386852 - DNA, 537 bp, Homo sapiens
  misc_feature: GZ8MTXP02GU6MK.22.86.H09.1.454.CMB.2.raw
  modified_base (459)..(459): a, c, t, g, unknown or other
  modified_base (502)..(502): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggacctaattatagtggtatgagtgggaaagtaaataaagactagtgtaggactccgtagaacgggccgattcaccatcctaccagacgacaactaccaaagaaccactctgtttacaccaaatgaaacngacctagagaggacgaacggacacggcaaggtcgtacttacgngtgaacgtagacgtactacggacagtacgaaacgg

SEQ ID NO: 386853 - DNA, 735 bp, Homo sapiens
  misc_feature: GZ8MTXP02H6B1H.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctagtggcatgcacgtggcctccgccagggccgtccggggcaaggggctggggaggtggggtggcctaaagttatagtgggtaatggaattggggaaagttaaataaaaggtactaagttggggtaggtaaaccgtcccgggtaggaaacggggtcccgtaagtttaccgaaccctacttccctacccgaaggtaacgaaacctaaaccttacccgaaaaacggtaaacctaaccgtttaccttacggtttttacctaaccccgtaaaaattacggaaaacctaacggacccgttaaggaagggaacggggaacccgggaaggggaaacccgaaccgggggtacctaaacgggttacggtttaaacgtttaacccggttagggttaccggtaaccgggtaaacgggtaaaggaaccggttaccgggaaaccgtaaacggttaacggttaaaacccgggg

SEQ ID NO: 386854 - DNA, 524 bp, Homo sapiens
  misc_feature: GZ8MTXP02F0B36.22.86.H09.1.454.CMB.2.raw
  modified_base (253)..(253): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattanatggtatgatggaagtaataaagactatgtggactccgtgaaggccgattcaccatctccagagacaactccaaagaacactctgtttctccaaaatgaaacagcctgagaggcgagacacggcagtgtattactagtgcgagagatcgacatagactaacgggaaatcttttagatctcgtggggacccaaaggggacacgtggtcacgtctacttcagcctccaccaaggcccagtccgtctcccccgtgcccgcctcgctccaggacg

SEQ ID NO: 386855 - DNA, 536 bp, Homo sapiens
  misc_feature: GZ8MTXP02GOPU7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcaccatctccagagacaactccaaagaacactctgtttctccaaatgaacagcctgagaggcgaaggacacggcagtgtattactgtgcgagagatcgaacatgaactaacggggaaatcttttaggattcgtcgtggggaccaaggggacacgtggtccaccgtctcttcagcctcaccgaacggcccacgtccgtccttccccgtggccgtccctgcctccgacgtaccg

SEQ ID NO: 386856 - DNA, 589 bp, Homo sapiens
  misc_feature: GZ8MTXP02IWAO3.22.86.H09.1.454.CMB.2.raw
  modified_base (252)..(252): a, c, t, g, unknown or other
  modified_base (376)..(376): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggagtgggtggcaattntatggtatgatggaaagtaataagactatgtgactcgtaggaaggccgatcaccatctcagacacaactcaaagacactctcgttacacaaatgaacagcctgagaggcgagacgacggcagtntattacgtgtagcgaagtagactcgacagtacgacgtaaacgggaaattctttaggatccgtcgggtacgggggacccaaaggggtacctacggtacggtaccaccggttctccgtttaccgaccgtccctacccgaaaccgacggggcccctaaccgttcccggttccctcccccgtacgggccgtccccctagcccgtaccgacggtaccg

SEQ ID NO: 386857 - DNA, 572 bp, Homo sapiens
  misc_feature: GZ8MTXP02HUBBA.22.86.H09.1.454.CMB.2.raw
  modified_base (536)..(536): a, c, t, g, unknown or other
  modified_base (552)..(552): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtgctagtggcatgcactggctcccgcaggcctccggggcgaaggggctggggaggtggggtggacctaatttatagtggtatggatgggaaataataaagcttagtggtaggactccgtaggaaacggggctaagttcaaccctatcctaccaagacgacaaactaccaaagaaccacttactcgttttaccacccaaatcgaaactacgcctaggaagaggaccggaggaacgacgggactaaggtacgttattacgttgnggaacgaaggacgtanacgaacagttacggaaaacg

SEQ ID NO: 386858 - DNA, 505 bp, Homo sapiens
  misc_feature: GZ8MTXP02JSTIY.22.86.H09.1.454.CMB.2.raw
  modified_base (363)..(363): a, c, t, g, unknown or other
  modified_base (483)..(483): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgcagcgtctggattcaccttcagtggctatggcatgcactggctccgcaggctccgaggcaaggggctgggagtggggtgcaattatagtggtatgatgggaaataaataaagntatgtggactcgtagaagggccgattcacatctccagacgacaactccaaagactactcttgtttacaccaaatcgaaacagcctagacgaggacgaggacacgggcagtgtacttacgngtgcgagagatcgaacagtacg

SEQ ID NO: 386859 - DNA, 608 bp, Homo sapiens
  misc_feature: GZ8MTXP02JYQ70.22.86.H09.1.454.CMB.2.raw
  modified_base (363)..(363): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcacgtggctccgccaggccgtcccggggcaaggggctaggggaggtggggtggacctaagtttatagtggttanggatggggaaataaataaaaggactagtgggtacggtacctaccggtaggaaacggggcccgtattacccgaaccctagttccctacccgaagaacgaacctaaaccgtaccaaagaaacctacgtcttacgtttactacctaaaatacgaaacacgcctaggaacgagggacggacggaacgacgggactaggtacgttataccgtgtcgaacgagacgtacgtaccggacagtacgtaaacgg

SEQ ID NO: 386860 - DNA, 540 bp, Homo sapiens
  misc_feature: GZ8MTXP02GN2LG.22.86.H09.1.454.CMB.2.raw
  modified_base (251)..(251): a, c, t, g, unknown or other
  modified_base (520)..(520): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattntatggtatgatggaagtaataaagactatgtgactccgtgaaggccgattcaccatctccagagacactacaagaacactctgtttcaccaaatgaacagcctgagaggcgagacacggcagtgtattactgtagcgagagatcgacatgaacgtaacgggaaagtcttttggattcgtacggtcgggggaccaaagggggacacgtcggttccaccgttctacttcacgtcctaccgaacgaacgggcccacgtccgtccctccccgngccgccctgcctcgagaccg

SEQ ID NO: 386861 - DNA, 673 bp, Homo sapiens
  misc_feature: GZ8MTXP02H0DW3.22.86.H09.1.454.CMB.2.raw
  modified_base (226)..(226): a, c, t, g, unknown or other
  modified_base (252)..(252): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctgggagtgggtgcaaattntagtggtaatgataggaaagtaaataaagactatggtaggactccggtaggaacgggccgattaccacctatcctaccgagaacgaacaactaccaaagaaacctacttcttacgttttacctaacccaaatacgaaacacgaccgtggaagaacgggaccgaaagggaaccacgggtactaggttagtaacttacgtggtaggacgaagaagtactcgaacagtagaaccgtaaaggggaaattcttttggaacttcgtacgggtacggggacccgaaaggggacctaacgtcgggtaccctaccgtccttaccttacgacgtccctacccgaaaccggaaaccgggtccctaacgttccccgggttcccttcccccggtcgggaccctccccgtacgccccgtccgaacgggtaccccg

SEQ ID NO: 386862 - DNA, 548 bp, Homo sapiens
  misc_feature: GZ8MTXP02J0KRX.22.86.H09.1.454.CMB.2.raw
  modified_base (317)..(317): a, c, t, g, unknown or other
  modified_base (333)..(333): a, c, t, g, unknown or other
  modified_base (378)..(378): a, c, t, g, unknown or other
  modified_base (400)..(400): a, c, t, g, unknown or other
  modified_base (403)..(403): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattatatggtatgatggaagtaaataaagactatgtggactccgtgaagggccgattcacatctcaganacaactccaaagaacnctctcgtttctccaaaatgaacagcctgagaggcgagacacgganagtagtatatgtgacgagagancanagtagaacgtaaggaagtcttagtatcgtcggtacgggacgaagggacacgtcggtactaccgtctcttcgacgccctaccaccgacggaccctacgtcccgtaccctcccccgtcggcccgacccgtcgccgtaccgacggacg

SEQ ID NO: 386863 - DNA, 563 bp, Homo sapiens
  misc_feature: GZ8MTXP02H78MF.22.86.H09.1.454.CMB.2.raw
  modified_base (395)..(395): a, c, t, g, unknown or other
tcagacatacgcgtcacgaccggtgctcgatttagtgctatagacttgggtttgggctgagcgtggttttcgtcgttagctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagatatgtggactccgtgaaggccgattcaccatctccagagacaactccaagaacactctcgttctaccaaatgaacagcctgagagcgagacacggcagtgtatagtgtgcgagaganacgaacagtagacgtaacggtaagttacgtttagtagtacgtcggtacgggacggaacggacgacgtcggtacgtaccgtcgttcttcgtacgcctacccgaccgaaccggacccgtaccgtccgttcccgttccccgtccgccgtcccgtccgtccgtccgacgacg

SEQ ID NO: 386864 - DNA, 505 bp, Homo sapiens
  misc_feature: GZ8MTXP02I102C.22.86.H09.1.454.CMB.2.raw
  modified_base (338)..(338): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctcccggggcaaggggctgggagtggggtgccaattntatggtatgatgggaaataataaagctatgtggactcgtgaggcgatcacatctccagacgacaactaccaaagaacacttcttcgtttactaccaaatgaacagcctgagaggacgacggacacggcagtcgtactactgtgcgagacgactcgacagtacgaacg

SEQ ID NO: 386865 - DNA, 561 bp, Homo sapiens
  misc_feature: GZ8MTXP02FNNM7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactcgtgaaggccgattcaccatctccagagacaactcaaagaacactctcgtttctaccaaatgaacagcctgagaggcgaggacacggcagtgtattactgtgcgagagatcgacatagacgtaacgggaaatcttttgattcgtcggtaggggacccgaaggggactacgtgggtaccaccgtcttccgttcacgccctacccaaccgaaaccggcccgtaactcccggttccctcccccgtcggcccgtcccgtcgcctaccgacggaccg

SEQ ID NO: 386866 - DNA, 548 bp, Homo sapiens
  misc_feature: GZ8MTXP02HTIEY.22.86.H09.1.454.CMB.2.raw
  modified_base (226)..(226): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctggagtgggtggcaattatatggtatgatggaaagtaaataaagactatgtggactcgtgaaggccgtatcaccatctccagacgacaactcaaagaacactctgtttcaccaaatgaacagcctgagagcggagacgacggcagtgtatactgtagcgaagagatacgacagtagacgtaaagggtaaatcttttaggattcgtcggtacggggacgtaaagggcacgtcggtcctaccgtctcttacacgcctccaaccgaacggccctacgtccgttcctccccgtcgccgtccctcgcctccgacggaccg

SEQ ID NO: 386867 - DNA, 547 bp, Homo sapiens
  misc_feature: GZ8MTXP02GYFEB.22.86.H09.1.454.CMB.2.raw
  modified_base (392)..(392): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaggccgatcacatctccagagacaactccaaagaacactctgtttcacaaatgaacagcctgagaggcgagacacggcagtgtattactgtgacgaganagtcgacatagaacgtaacgggaaagtcttttagatctcgtggggacccaaggggacacgtggtaccaccggtctaccttcacgcctacccaaccgaacgggccccacgtccggtccttcccccgtcggcccgtccctggccctccgacggaccg

SEQ ID NO: 386868 - DNA, 648 bp, Homo sapiens
  misc_feature: GZ8MTXP02G9OLH.22.86.H09.1.454.CMB.2.raw
  modified_base (317)..(317): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtggctatggcatgcacgtggcctccgccgaggccgtcccggggngaaggggctggggaggtggggtggaccctaaagtttagtagtgggtataggaagtaggggaaagttaaactaaaagacttaagtacgggtagggaaccttccggtaggaaacggggtccctaagttcccaacctattcccgaaccaaggaacgaaaccaacctacccgaaaagaacctaccttcttacgtttccaaacccaaaagtcgaaacacgtaccaggaacggacgggacggaacggaaccgacgggtactaagggttacgttaagttaaccggtgtacgggaacgaggaacgtacgtacggaactaaggtacggtaaaaacccggg

SEQ ID NO: 386869 - DNA, 625 bp, Homo sapiens
  misc_feature: GZ8MTXP02FSHNO.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggctaattatagtggtatgataggaaataataaagactagtgtggactccggtagaagggccattccacatctccagagacaactacaaagacactcttcgtttacctaccaaatgaaacacgcctggagaggacgaggacacggacagttagtattacgtgtagacgagagatacgacagtacgacgtaacggggaaatcgtttagattcgtacggtacggggacccgaaaggggacctaacggttcggtacctacccggttccttccttaccgacgccccttacccgaacccggtaaacgggtcccctaaccgttcccgggttccccttcccccggtcgggccccgtccccgttcgccctacccggacggtaaccccg

SEQ ID NO: 386870 - DNA, 653 bp, Homo sapiens
  misc_feature: GZ8MTXP02IERL6.22.86.H09.1.454.CMB.2.raw
  modified_base (321)..(321): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaaggggctgggaggtgggtgctaattatagtggtatgataggaaataaataaagactatgtggactcggtgaaggcgatcaccatctccaganacaactcaaagacactctcgttacaccaaatgaaacagcctgagaggcgagacacggcagtgttatacgtgtgacgagagactacgaacagtacgaacgtaaacggggtaaacgttcgttttagaacgttccgtacgggtacgggggacccgaaaaggggtacctaacggttcggggtacctacccggttccttcctttaccgaaccggtccccttaacccgaaaccccggaaacggggtccccctaacggtttccccggttacccccgttttcccccccggcggtcccccggtcccccgtacggtccccgttaccggaacgggtaaccccg

SEQ ID NO: 386871 - DNA, 561 bp, Homo sapiens
  misc_feature: GZ8MTXP02JN5CI.22.86.H09.1.454.CMB.2.raw
  modified_base (272)..(272): a, c, t, g, unknown or other
  modified_base (342)..(342): a, c, t, g, unknown or other
  modified_base (527)..(527): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaanaaagactatgtggactccgtgaaggccgatcacatctccagagacaactccaaagaacactctcgtttcnccaaatgaacagcctgagaggcgaggacacggcagtgtattacgtgtgcgagagatcgacatgactagggaaatctttagatctcgtaggggaccaaggggactacgtgggtacctaaccgtcgtcttacacgtcccctaccaaccgaaacggggtccccaacgttcccggtccctttcccccgnggtcccgtccccgtcggccttcccgagggacccg

SEQ ID NO: 386872 - DNA, 532 bp, Homo sapiens
  misc_feature: GZ8MTXP02IJV8Z.22.86.H09.1.454.CMB.2.raw
  modified_base (241)..(241): a, c, t, g, unknown or other
  modified_base (277)..(277): a, c, t, g, unknown or other
  modified_base (354)..(354): a, c, t, g, unknown or other
  modified_base (358)..(358): a, c, t, g, unknown or other
  modified_base (377)..(377): a, c, t, g, unknown or other
  modified_base (419)..(419): a, c, t, g, unknown or other
  modified_base (486)..(486): a, c, t, g, unknown or other
  modified_base (521)..(521): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaacgcccccagactcatcatttangctgtcaataagcggccctcgacggggtccctgatcgcttctctggctccaagtctggcacacggcctccctgaccntccnctgggctccaggctgaagntgaggctgtaattattactgtctgctctatttcgcacggtcncctacgtacgttgggtgttcggcggagggaccaagcgtcgaccgtctaggtccacgcccgaagtccnccgcccccgtcggtcctaccgttctccggttcccncccgtcctccg

SEQ ID NO: 386873 - DNA, 515 bp, Homo sapiens
  misc_feature: GZ8MTXP02IUZQ0.22.86.H09.1.454.CMB.2.raw
  modified_base (241)..(241): a, c, t, g, unknown or other
  modified_base (350)..(350): a, c, t, g, unknown or other
  modified_base (406)..(406): a, c, t, g, unknown or other
  modified_base (513)..(513): a, c, t, g, unknown or other
tcagacatacgcgtcacgaccggtgctcgatttagtgctatagacttgggtttgggaggagagacccctcccctgggctctgctcctcctcagcctcctcactcaggacacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaagccccagactcatcatttatgctgtcaataagcggccctcaggggtcccctgatcgcttctctggctccaagtctggcaacacgcctcctgaccntctctgggctccaggctgaagatgagctgattattactgctgctcatttgcaggcnctacacttgggtgttcggcggagggaccaaaggctacggaccgtcctaagggtccagcccaaggcctcggccccctggtccacgttctcgttccccgcctttccccncg

SEQ ID NO: 386874 - DNA, 572 bp, Homo sapiens
  misc_feature: GZ8MTXP02HXTPX.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaagtaataaagactatgtggactcgtgaaggccgattcaccatctccagagacaactccaaagaaccactctgtttctaccaaatgaacagcctgagaggcgaggacaggcagtatattactgtgcgagagatcgacagtagactaaagggaaatcttttggattcgtacgtcggggaccaaggggactacgtggtaccaccgttctccgtttcacgccccttaccgacccgaaacggggcccctaacgttcccggttcccttccccccgtgggcccgtccccgtgtcccgttaccgaacggtacccg

SEQ ID NO: 386875 - DNA, 535 bp, Homo sapiens
  misc_feature: GZ8MTXP02FPWP0.22.86.H09.1.454.CMB.2.raw
  modified_base (316)..(316): a, c, t, g, unknown or other
  modified_base (343)..(343): a, c, t, g, unknown or other
  modified_base (408)..(408): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggagtccctgagactctcctgtgcagcgtctggattcaccttcagtggctatggcatgcactggcctcccgcaggcctccggggnaaggggctgggagtgggtgactaattnagtggtatgatgggaaataataaacgactagtggtgactcgtagaacggcatcacatctacaganacaactaccaaagaacactcttgtttacaccaaaatcgaacagcctagaagagggacgaacggacgacggctaaggttacgtacttacgtggtacgaacgagagacgtcgaactagtacggtaaacg

SEQ ID NO: 386876 - DNA, 508 bp, Homo sapiens
  misc_feature: GZ8MTXP02GOFOF.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtctgggggaggcgtggtccagcctggggaggtccctgagactctcctgtgcagcgtctggattcaccttcagtggctatggcatgcactggctccgccaggctcccggggcaggggctgggagtggggtggccaattatatggtatgatgggaaataataaagctatgtgactcgtgaaggcgatcacatctcagagacaactaccaagaacactctgtttaccaccaaatcgaacagcctgagaggcgacggacacggcaggtgtacttacgtgtagcggagaggactcggacagtgtaaccgg

SEQ ID NO: 386877 - DNA, 544 bp, Homo sapiens
  misc_feature: GZ8MTXP02FVCV5.22.86.H09.1.454.CMB.2.raw
  modified_base (279)..(279): a, c, t, g, unknown or other
  modified_base (288)..(288): a, c, t, g, unknown or other
  modified_base (302)..(302): a, c, t, g, unknown or other
  modified_base (328)..(328): a, c, t, g, unknown or other
  modified_base (373)..(373): a, c, t, g, unknown or other
  modified_base (390)..(390): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtctctgagactctcctgtgcagcgtctggattcaccttcagtggctatggcatgcactggctccgccaggctcgggcaaggggctggagtgggtgcaattatatggtatgatggaagtaataaagatangtgactcgngaggcatcacatcncagagacaactccaagaacactcctntttcacaaatgaacagcctgagaggtgagacaggcagtgtaatgngtgcagagatcgactangaaccgtagggaaatctttagagttctcgtgggaccaaggggactacgttcggacctacgtcttcttcgacgtccctcccgaaccgaacgggcccctagttcccggttcccttccccccgtaggggtcccccgtcccgtacgcccgtaccgacg

SEQ ID NO: 386878 - DNA, 679 bp, Homo sapiens
  misc_feature: GZ8MTXP02HQTG2.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggcctccggggcgaaggggctggggaggtggggtcggacctaaagttatagtggttatggatggggaaagttaaataaaaggtcttaagtcggtaggaaccgtcccggtaggaaacgggggcccgtaagttaccaccctaattcccgtacccgaaggaacgaaaccaaaccgtacccgaaaacgaaacctactttacctttacgtttcctaaccctaaaagttacgaaacctaacggcccttaggaacgggaacgggacgggaacggggaacccgacggggaccgtaagggtttacggtttaactttaccggttaggttacggaaccgggaaggaacggacttaccgggaacctaacggttacggttaaaacccggg

SEQ ID NO: 386879 - DNA, 558 bp, Homo sapiens
  misc_feature: GZ8MTXP02IZZYR.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgcagcgtctggattcaccttcagtggctagtggcatgcactggctccgccaggcgtcccgggcaaggggctgggagtggggtgctaattagtagtgggtatggatggggaaagttaaataaaagcttaagtggtagggaccgtccggtaggaaacggggccgtattaccgaccctatcctaccaagacgaacaactaccaaagtaaccaacgttctacgtttcctaaccaaaatcggaaacacgcctagagaggcgaacggacgacggctagtgtacttacgtgtagcgagagactcgacagtagaacg

SEQ ID NO: 386880 - DNA, 625 bp, Homo sapiens
  misc_feature: GZ8MTXP02FWPZ5.22.86.H09.1.454.CMB.2.raw
  modified_base (241)..(241): a, c, t, g, unknown or other
  modified_base (340)..(340): a, c, t, g, unknown or other
  modified_base (355)..(355): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaacgcccccagactcatcatttatgctgtcaataagcggcccctcgacggggtccctgatcgcttctctggctcaagtctggcaacncggcctccctgaccntctctgggcctccgaggctgaagatgaggctgattattactgtctgctcgtatttcgctacgggcctaccctacgtacgtttcggggttcggttccggggacgggaacgggggacccaaaggtcccgttacggtaccccgtacccgttaaagggtcccgaacggaccccccgaaaggggtcccctccggtaccccccccgttcggggttaccctaacccgttcccgttccccggggttttccccccccgtcccccgttaccccgtacccg

SEQ ID NO: 386881 - DNA, 514 bp, Homo sapiens
  misc_feature: GZ8MTXP02FG2IH.22.86.H09.1.454.CMB.2.raw
  modified_base (339)..(339): a, c, t, g, unknown or other
  modified_base (346)..(346): a, c, t, g, unknown or other
  modified_base (397)..(397): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggatcaccttcagtggctatggcatgcactggctccgccaggctcccggggcaaggggctgggagtggggtgccaattanatggtangatggaaagtaaataaagactatgtggactccgtgaagggccgatcaccanctccagagacaactaccaaagaacactctgtttacctaccaaatacgaacagcctagagagggcgacggacgacggacagtacgtattacgtgtgcgagagactcgacatcgaacgg

SEQ ID NO: 386882 - DNA, 656 bp, Homo sapiens
  misc_feature: GZ8MTXP02FZKIW.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcacgtggcctcccgccgaggccgtcccggggcgaagggggctggggaggtggggtggacctaaagttatagtggtatggaattaggggaaagttaaacgtaaaaggcttaagtgggttacgggaaccttacccgggtaggaaacggggcccgtaattaccaaccctaactcctaccaaggaacgaaaccaaactacccgaaaagaaacctaccttcttacgtttacctaaccctaaaagttacggaaaacacgtacccgtaggaaacggaggggaccggaaacggaccgaaccgggacgtaaggttacgttaacgttaaccgtggtagaacgaagaacggactacggaactagtacgtaaaaccggg

SEQ ID NO: 386883 - DNA, 544 bp, Homo sapiens
  misc_feature: GZ8MTXP02GZX5U.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccaggcctggggaggtccctgagactctcctgtgcagcgtctggattcaccttcagtggctatggcatgcactggctcccgcaggcctccgggcaaggggctgggagtggggtgaccaagttatagtggtatgaatgggaaataaataaagactagtgtaggactccgtagaacgggccgattcacctatcctcagagacaactaccaaagaacactcttacgtttacctaccaaatacgaaacacgccgtaggaggaggacggaacggacacggcagtacgtaattcgtgtagaacggagaggactacgacagtacggaacg

SEQ ID NO: 386884 - DNA, 575 bp, Homo sapiens
  misc_feature: GZ8MTXP02JPD34.22.86.H09.1.454.CMB.2.raw
  modified_base (248)..(248): a, c, t, g, unknown or other
  modified_base (259)..(259): a, c, t, g, unknown or other
  modified_base (269)..(269): a, c, t, g, unknown or other
  modified_base (274)..(274): a, c, t, g, unknown or other
  modified_base (277)..(277): a, c, t, g, unknown or other
  modified_base (280)..(280): a, c, t, g, unknown or other
  modified_base (284)..(284): a, c, t, g, unknown or other
  modified_base (288)..(288): a, c, t, g, unknown or other
  modified_base (290)..(290): a, c, t, g, unknown or other
  modified_base (292)..(294): a, c, t, g, unknown or other
  modified_base (297)..(297): a, c, t, g, unknown or other
  modified_base (303)..(303): a, c, t, g, unknown or other
  modified_base (321)..(321): a, c, t, g, unknown or other
  modified_base (323)..(323): a, c, t, g, unknown or other
  modified_base (326)..(326): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcgtggtttccgcgtagctctttaagaggtgtccagtgtcaggtgcagctggtggagtcgtgggggagcgtggtccagcctgggngtcctgagctntcctgtgccngcgtntgntcnctcngtgntngnnngcncgcgcnccgcgcgcgcggcgaggngnggngtggtgagtatagtagtgtagtagtagtagtaagtaaagtaaagtagtagtagtacggtacgtacggtaggaacggtacgtacgtaccgtaccgtacgtaccgtaccgacgaacgaaccaacctaaccgaaacgaacctaaccttacgttacgttacctaccgtaaactaacgaacgacgacgtacgaggacggacggacggacgacgacgtagtagtaagtacgtacgtacgacgacgacgacgtacg

SEQ ID NO: 386885 - DNA, 567 bp, Homo sapiens
  misc_feature: GZ8MTXP02HUDQA.22.86.H09.1.454.CMB.2.raw
  modified_base (527)..(527): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggagtcgtgggggagcgtggtccagcctgggagtccctgagactctcctgtgcagcgtctggattcaccttcagtggctagtggcatgcactggctcccgccaggcctccgggcaaggggctgggagtggggtggcaattatagtggtatgaatgggaaagtaaataaagactatggagtactcgtagaacggccgattcacatcctacagacacaactaccaagaaacctacttactacgtttacaaccctaaatacgaaacacgaccgtagaaggacggaccggaacggaccgaacgggaccaaggttacgtagttaaccgttggnggaaccggagaagtacgaccgaacgtagttacggaaacgg

SEQ ID NO: 386886 - DNA, 522 bp, Homo sapiens
  misc_feature: GZ8MTXP02GBC7Y.22.86.H09.1.454.CMB.2.raw
  modified_base (316)..(316): a, c, t, g, unknown or other
  modified_base (394)..(394): a, c, t, g, unknown or other
  modified_base (400)..(400): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaggggcngggagtggggtggccgtaattatatgggtatggatgggaaagtaaactaagactatgtgactcgtgaggcgatcacanctacanagacacacaagacactactgttacctacaatacgaacgtacgactagacgacggacggacggacgacggacgacgtcggtattacgtgtggaacgagaggactacgacgtacgtagtaacgg

SEQ ID NO: 386887 - DNA, 512 bp, Homo sapiens
  misc_feature: GZ8MTXP02JTOIN.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccggcaaggggctgggagtggggtggcaattatatggtatggatggaagtaataaagactatgtaggactcgtgaagggcattcacatctccagagacaactcaagacactctgttactacaaatagaactagcctagagacggacgaggacgacggcagtagtaacttacgtgtacgcgagagatacg

SEQ ID NO: 386888 - DNA, 584 bp, Homo sapiens
  misc_feature: GZ8MTXP02IJARP.22.86.H09.1.454.CMB.2.raw
  modified_base (377)..(377): a, c, t, g, unknown or other
  modified_base (404)..(404): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaaggggctgggagtgggtgcaattatatggtatgatggaagtaataaagactatgtggactccgtagaagggccgattcaccatctcagagacaactcaaagaacactctctttcaccaatagaacagcctgagaggcgagacacggganagtatatacgtgtgagagagacacganagtacgaacgtaacggtaagttcgtttagacgtcgtacgggtacgggaccgaacgggactacggtcggtacctaccgtcttcttaccgaccgtcccgtacccgacccgaaccggacccgtaccgtcccgttccccgttccccgtcccggtcccgtcccgtccgtccgtaccgacggaccg

SEQ ID NO: 386889 - DNA, 578 bp, Homo sapiens
  misc_feature: GZ8MTXP02JOIBG.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggctccgggcaaggggctggagtgggtggcaattatatgtatgatggaaagtaataaagactatgtggactccgtgaacggcgattcacatctccagagacaactcaaagaacactctcgtttcaccaaatgaacagcctgagaggcgagacacggcagtgtattacgtgtgcgaagagatcgaacagtagaacgtaaacgggaaattcttttagactcgtcggtacggggaccaaagggactacgtgggtacctaccggtctcttacgacgccctacccgaaccgaaaccgggccccaacgttcccggtcccttcccccggtcggtcccgtccccgttcgcccttaccgacggtacccg

SEQ ID NO: 386890 - DNA, 520 bp, Homo sapiens
  misc_feature: GZ8MTXP02F07ZK.22.86.H09.1.454.CMB.2.raw
  modified_base (342)..(342): a, c, t, g, unknown or other
  modified_base (399)..(399): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagcctgggaggtccctgagactctcctgtgcagcgtctggattcaccttcagtggctatggcatgcacgtggctccgccaggcctccggggcaaggggctgggagtggggtgctaattnatggtatgatgggaaataaataaagactatgtagactcgtgaaggccgatcacatcncagacacactaccaagaactactcttgtttactaccaaaatgaaacagacctgaagagggcgaaggacgacggacaggtacgttattactggtagcgagagacgtcgaacatacgaaacgg

SEQ ID NO: 386891 - DNA, 543 bp, Homo sapiens
  misc_feature: GZ8MTXP02IQ33X.22.86.H09.1.454.CMB.2.raw
  modified_base (520)..(520): a, c, t, g, unknown or other
  modified_base (528)..(528): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgcactggctcccgcaggctccgggcaaggggctgggagtggggtgacctaaattatagtggtatggatgggaaagttaaataaaagactaagtggtacgggaactccgtaggaaagggccgattacaaccactctaccagaagacaactaccaaagaaccaacttctacgtttctaccaaaatcgaaacagccagaagagacgaacggaccaggcagtcgtacttacgtgagngaagaganacgacagtacgaacg

SEQ ID NO: 386892 - DNA, 614 bp, Homo sapiens
  misc_feature: GZ8MTXP02GW631.22.86.H09.1.454.CMB.2.raw
  modified_base (250)..(250): a, c, t, g, unknown or other
  modified_base (306)..(306): a, c, t, g, unknown or other
  modified_base (385)..(385): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacttcagtggctatggcatgcactggctccgcaggctccgggcaaggggctgggagtgggtgcaattntatggtatgataggaaataataaagactatgtggactcgtagaaggcatcacatcncagacacaactacaaagaacactctcgtttacaccaaatcgaacagctgagaggcgaagacacggcagtgtattactgngacgagagactcgaacatacgaaccgttaaaggggaaattcgttttaggaatccgttacggtacggggaacccgaaaggggacctaacggtcggtacccgtaaccggttcgtaccgtttaccaccggtaccctaccgaaacccgaaaccgggggtcccctaacgttccccgggttcccttcccccggtcgggcccttccccgtacgtacccgtcccgaaacggggcccg

SEQ ID NO: 386893 - DNA, 626 bp, Homo sapiens
  misc_feature: GZ8MTXP02HRW4J.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaaataaagactatggtggactccgtaggaacgggccgtattccaccatcctaccaagagaccaactaccaaagaaccactcttcgtttacaccaaatcgaacacgctgagagacgagacacggctagtgtatacgtgtgcgaagagatacgaactagtacgaacgtaaacgggtaaagttcgttttagacttcgtcgggtacgggggaccgaaagggggacctacggttcggtacctacccggtcttaccgttaccgaccggtaccctaccccgaaacggaacccgggtaccctacgttccccggttccctccccccggtggcccccgtcccgtcgccctaccggacggacccg

SEQ ID NO: 386894 - DNA, 543 bp, Homo sapiens
  misc_feature: GZ8MTXP02IEFKX.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaaggggctggagtgggtggcaattatatggtatgatggaaagtaataaagactatgtggactccgtgaaggccgattcaccatctccagagacaactccaaagaacactactcgtttactaccaaaatgaaacagcctgacgaggcgagacacggcagtgtatactgtgcgagagatcgacatgactacggggaaatcttttgatctgtggggaccaagggcacgtcggtcaccgtctcttcacgtccctacaccgaacgggtccccagttccggtccttcccccgtggccctcccctgccctccgaacgggccg

SEQ ID NO: 386895 - DNA, 516 bp, Homo sapiens
  misc_feature: GZ8MTXP02IW3LP.22.86.H09.1.454.CMB.2.raw
  modified_base (503)..(503): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactaatgtggactccgtgaaggccgattcaccatctccagagacaactccaaagaacactctgtttctccaaatgaacagcctgacgaggcgaggacacggcagtgtattactgtgcgagagatcgacatgactacggggaaagtcttttagatctcgtggggccaaggggacacgtggtcaccgtctcttcagcctccaccacggcccagtccgtctccccgtgcnccctgctccagcg

SEQ ID NO: 386896 - DNA, 628 bp, Homo sapiens
  misc_feature: GZ8MTXP02FTHUI.22.86.H09.1.454.CMB.2.raw
  modified_base (253)..(253): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattanatggtatgatggaaagtaataaagactatgtggactcgtgaaggccgattcacatctccagacgacaactccaaagaacactctgtttacctaccaaaatgaacagcctggagaggacgagacacgggcagtgtattactgtgcgagagatcgacatagacgtaacgggaaatcttttagacttctacgtcgggggaccaaaggggtacacgttgggtacctaacccggttctacctttacgaacggtacccttacccgaaacccgaaacgggggtccccctaaacgttccccgggtttaaccccttcccccccggttaggggacccccgtacccccgttacggcccctttaccccggaaaacggggtacccccg

SEQ ID NO: 386897 - DNA, 512 bp, Homo sapiens
  misc_feature: GZ8MTXP02GU0IJ.22.86.H09.1.454.CMB.2.raw
tcagacatacgcgtcacgaccggtgctcgatttagtgctatagacttgagctctggggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgcaggctccgggcaggggctgggagtggggtggcaatatatggtatgatgggaataaataaagactagtgtgactcgtgaaggcgatcactatctccagacgacaactaccaaagaacactactgtttacctaccaaatagaacagcctagagaggcgaggacgacggctagtacgttatacgtgtagcgagagtatacgacagtacgaacg

SEQ ID NO: 386898 - DNA, 538 bp, Homo sapiens
  misc_feature: GZ8MTXP02JNJNC.22.86.H09.1.454.CMB.2.raw
  modified_base (392)..(392): a, c, t, g, unknown or other
  modified_base (399)..(399): a, c, t, g, unknown or other
  modified_base (518)..(518): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggcaagggctggagtgggtgcaattatatggtatgatggaagtaataaagactatggtggactccgtagaagggccgattcaccatctcagagacaactccaaagaacactctgtttcaccaaatcgaacagcctgacgaggcgagacacgggcagtagtatactgtgngagagancgacatgactaacgggaaagtctttgatctcggtgggacccgaagggacagtcggtaccaccgtctcttacaggccctacaccgaacgggtccccagtccggtcctccccgcggtcccncccgtgcctcccgaggtccc

SEQ ID NO: 386899 - DNA, 525 bp, Homo sapiens
  misc_feature: GZ8MTXP02GJ2AM.22.86.H09.1.454.CMB.2.raw
  modified_base (328)..(328): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgcaggctccggnaaggggctgggagtgggtgactattatatgggtatggagtagggaagtaataaagactaagtggtaggactccggtaggaaacgggccgattcgacatctaccagacgacaactacaagacactctgttacacaaatcgaacagcctagacgaggcgaggacacggcagtgtaatacgtgtacgacgagagactacg

SEQ ID NO: 386900 - DNA, 494 bp, Homo sapiens
  misc_feature: GZ8MTXP02I5WS9.22.86.H09.1.454.CMB.2.raw
  modified_base (340)..(340): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggggaggtccctgagactctcctgtgcagcgtctggattcaccttcagtggctatggcatgcactggcctccgccaggctcccggggcaaggggctggagtggggtgcaattntatggtatgatgggaataataaagactatgtggactcgtgaggcattcacatctcagagacaactaccaagaacactctgtttctaccaaatgaacagctagagaggcgaggacacggcagtgtatacgtgtgcgagagatcgacatagtaacg

SEQ ID NO: 386901 - DNA, 614 bp, Homo sapiens
  misc_feature: GZ8MTXP02H3ZNC.22.86.H09.1.454.CMB.2.raw
  modified_base (325)..(325): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcagtggctatggcatgcactggcctccgccaggctccgagacggaggcgtgggnggtgggcgactaagttagtagttgtagtgtagtagggtaaataaacgtaaacgtattagtggtacggaccgttaccggagggaaccgggacgtactaccaaccgtactcctacgaacggacgaaccaaaccgtaaccgaaaacgaaacccttaccgttactttacggttttacccaaacccgtaaagtaacgaaaccgcgtaccgtagaacggacggacggaacggaaccgacgacgtacggttagtacttacgtgtaaggacgaagtacgagtaccacgtagtaacgg

SEQ ID NO: 386902 - DNA, 539 bp, Homo sapiens
  misc_feature: GZ8MTXP02JXWH6.22.86.H09.1.454.CMB.2.raw
  modified_base (313)..(313): a, c, t, g, unknown or other
  modified_base (464)..(464): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagctctcctgtgcagcgtctggattcaccttcagtggctatggcatgcactggctccgccgaggcctccggggnaaggggctggggaggtggggtggacctaattatagtggtaatggaagtaggggaaagtaaataaaggactagtggtgactccgtgaaggccgatcacccatcctcagagacaactccaagaacacgtctgtttacctaccaaatcgaaacngcctaggaagaggaccgaggacgacggctagtctagtactggtagcgagtacgacgtacgactagaggtaaaccg

SEQ ID NO: 386903 - DNA, 592 bp, Homo sapiens
  misc_feature: GZ8MTXP02J11E1.22.86.H09.1.454.CMB.2.raw
  modified_base (312)..(312): a, c, t, g, unknown or other
  modified_base (328)..(328): a, c, t, g, unknown or other
  modified_base (336)..(336): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggaggtccctgagactctcctgtgcagcgtctggattcaccttcagtggctatggcatgcactggctccgcaggctccgggnaggggctggagtgggngcaattanatggtatgatgggaaagtaaataaagactatgtggacctccgtagaagggccgaattcaccatctccgagacgacaactaccgaaagaaccaactcttacgtttacctaaccctaaaattacggaaaccacgtaccgttaggaaggacggggaccgaaggggaaccgaccggggacctaaaggttggttaaacttaaccggtggttaggaaccggagtaagggacttacccgggaactacggtaggtaaacccggg

SEQ ID NO: 386904 - DNA, 640 bp, Homo sapiens
  misc_feature: GZ8MTXP02G9BTW.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggcctccgcgaggctcccggggcgaaggggctgggaggtggggtgacctaagttagtagtggtatggaatggggaaagttaaataaaggacttaagtggtacgggaccgttacccggtaggaaacggggtcccgaacgtttccaaccctactccctacccaagacgaaccaaaccgtaccaaacgaacctaccttcttacgtttaccaaccctaaaagttcgaaacgtacgaccgtaggaagacggggacggaaacgggaacccgaccggggacctaagggttacgttaacgttaaccgtggtacggcgtaaaggacgtaagtaccgaccgtaagttacggtaaaaccgg

SEQ ID NO: 386905 - DNA, 550 bp, Homo sapiens
  misc_feature: GZ8MTXP02GG7RA.22.86.H09.1.454.CMB.2.raw
  modified_base (520)..(520): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccggggcaaggggctgggagtggggtggaccaattatagtggtatggaatgggaaagtaaataaacggactaagtggtaggacgtccgtaggaaacgggccgaattccacctatcctaccaagacgacaactaccaaagaaactactactcgtttactaccaaatcgaaacagcctagaagaggacgaacggacgacggactagtacgtattacngtgaacgagagactcgactagtagaaacgg

SEQ ID NO: 386906 - DNA, 573 bp, Homo sapiens
  misc_feature: GZ8MTXP02HYUPV.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagctctcctgtgcagcgtctggattcaccttcagtggctatggcatgcactggcctccgccgaggctccgggcgaaggggctgggaggtggggtggacctaaagttatagtgggtatggatggggaaagtaaataaagactagtgtaggacgtccgtaggaaagggtcccgtattccaaccgtatcctaccgaagaacgaccaaactaccaaagtaaaccacttcttacgtttacaccctaaatacgaaacagcctaggagaggacgaggacacgggactaggtagttaacttacctggtacggaacgagaacgatacggactagtacgaaacgg

SEQ ID NO: 386907 - DNA, 538 bp, Homo sapiens
  misc_feature: GZ8MTXP02JKV56.22.86.H09.1.454.CMB.2.raw
  modified_base (316)..(316): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccagccgtgggaggtccctgagactctcctgtgcagcgtctggattcaccttcagtggctatggcatgcacgtggctccgccaggcctcccgggngaaggggctgggaggtggggtggacctaattatatgggtatgatgggaaagtaaataaagactagtgtggactcgagaacggcgattcacctatcctacgagacgacaactacaaagacactcttagttacctacaaatcgaacagcctaggagacggcgacggacgacggctaggtagtacttacgtggtgaacgtagagtacgcgacaggtacgaaacgg

SEQ ID NO: 386908 - DNA, 552 bp, Homo sapiens
  misc_feature: GZ8MTXP02H4M51.22.86.H09.1.454.CMB.2.raw
  modified_base (333)..(333): a, c, t, g, unknown or other
  modified_base (363)..(363): a, c, t, g, unknown or other
  modified_base (399)..(399): a, c, t, g, unknown or other
  modified_base (504)..(504): a, c, t, g, unknown or other
  modified_base (535)..(535): a, c, t, g, unknown or other
  modified_base (541)..(541): a, c, t, g, unknown or other
  modified_base (549)..(549): a, c, t, g, unknown or other
tcagacatacgcgtcacgaccggtgctcgatttagtgctatagacttgggtttgggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccaggcctggggaggtccctgagactctcctgtgcagcgtctggattcaccttcagtggctagtggcatgcactggctccgccaggctccggggnaaggggctgggagtggggtggctaagttanagtggtatgatagggaaagtaagtaaagactagtgnggactccggtaggaacgggccgtagttccaacctatccgtaccagacgaacaacgtaccaaagaacacttctacgttactaccaaatacgaacagcctagaacgnggacgaggacgacggacagtagtaattacgngtacgngagagtanacg

SEQ ID NO: 386909 - DNA, 641 bp, Homo sapiens
  misc_feature: GZ8MTXP02HZLNU.22.86.H09.1.454.CMB.2.raw
  modified_base (362)..(362): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtggactccgtgaagggccgattcaccatctccagagacaactaccaaagaacactctcgtttctaccaaatcgaacancctgagaggcgaggacacggcagtgtattacgtgtgacgagtaagatcgaacagttagaacgtaaacggggtaaaagttccgtttttaggaacttcgttacgggttacgggggacccgaaagggggacctaacggttcgggttacccaaccggttccttacctttcaacggttccccttacccgaaacccggtaaaccggggcccctaacgttcccgggttcccctttccccccggcggtcccgtcccccgttacggcccttacccggacgggaacccg

SEQ ID NO: 386910 - DNA, 572 bp, Homo sapiens
  misc_feature: GZ8MTXP02IF96I.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaaattatatggtatgatggaaagtaataaagactaatgtggactccgtgaaggcgattcaccatctcagagacaactcaaagaacactcttcgtttctaccaaatgaacagcctgagaggcgagacacggcagtgtatactgtgcgagagatcgacagtagactaacggggaaaatcgttttagatcgtacgtgggggacccaaaggggacacgtggtccaccgtctcttacacgccctacgaacccaacggggtcccaacgttccgggttaccctttccccccgcggtaccccgtcccgttacgcccgttaccgaacggcccgg

SEQ ID NO: 386911 - DNA, 548 bp, Homo sapiens
  misc_feature: GZ8MTXP02IIQCY.22.86.H09.1.454.CMB.2.raw
  modified_base (533)..(533): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtagtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaggccgattcaccatctccagagacaactccaaagaaccactcttcgtttactaccaaatgaacagcctgagaggcgagacgaggcagtgtatactgtgcgagagatcgactatagaacgtaaacggggaaagttcttttaggattacgttcggtagggggacccaaaggggacacgtcggtctaccgtctcttcacgccctaccaccgaacggcccacgtccgtcctcccgcggccncctgcctcacggacc

SEQ ID NO: 386912 - DNA, 539 bp, Homo sapiens
  misc_feature: GZ8MTXP02G3SY5.22.86.H09.1.454.CMB.2.raw
  modified_base (526)..(526): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcaccatctccagacgacaactccaaagaacactctcgtttcaccaaatgaacagcctggagaggcgaggacacggcagtgtattactgtgcgagagatcgaacagtagaacgtaagggaaatcgtttagagttcgtgtacggggaccgaagggacacgtcggtaccaccgtctcttcacgtcctccacgacggccctagtccggtcctccccgtgccgtccncgcctccgaggcc

SEQ ID NO: 386913 - DNA, 672 bp, Homo sapiens
  misc_feature: GZ8MTXP02HJX7Q.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtcgcagcgtctggacttccaccttcagtggctagtggcatgccacgtcggcctccgccgaggccgtcccgggacgaaggggctggggaggtggggtcgacctaaagttatagttaggtataggaagtagggaaaagttaaataaaacgtagttagttaggtacgggaccgtacccgggtaggaaacggggtacccgtaacttaccaaccctagtccctaccgaaagacgaaacctaaacctacccgaaaacgaacctacctttcttacgtttacctaaaccctaaagtcgaaaaccgagtaactaggaaacggaggggaccgaaagggaaccgaccgggtaacgtaaggttaggttaaaccttacggtagttaggaaccggaaggaagtacgtacgtaaccgagttaacggttaaaaccgggg

SEQ ID NO: 386914 - DNA, 620 bp, Homo sapiens
  misc_feature: GZ8MTXP02GYFEE.22.86.H09.1.454.CMB.2.raw
  modified_base (290)..(290): a, c, t, g, unknown or other
  modified_base (330)..(330): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttnagtggctatggcatgcacgtggctcccgcaggctccgggnaaggggctgggagtggggtgactaattagagtgggtaatggaatagggaaagtaaagtaaagacttaagtggttaggacgttaccggtaggaaacggggtcccgtatttccgaacctactcctacccgaaagacgaaaccaaacctacccaaagtaaaccacttccttacgtttacctacctaaaattacgaaacctacgacccgtagacggaagggaccggaaggaaccgaaccgggaccgaaggttagtaacgttaacgtggtacggacggaacggagtacgtaccgg

SEQ ID NO: 386915 - DNA, 522 bp, Homo sapiens
  misc_feature: GZ8MTXP02IGTSC.22.86.H09.1.454.CMB.2.raw
  modified_base (340)..(340): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctccgccaggctccggggcaaggggctgggagtggggtggccaaattanatgggtatggatgggaaagtaaataaaggactaatgtagactccgtagaaagggcccgagttcaaccatctaccagacgacaactaccaaagaacactctagtttcaccaaatcgaacacgctgagaggacgacggacgacggcagtcgtattacgtgtgcgagacgatcgacatagaacgg

SEQ ID NO: 386916 - DNA, 578 bp, Homo sapiens
  misc_feature: GZ8MTXP02GLV7W.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggacaggggctgggagtgggtggcaattatatggtatgatggaaagtaataaagactatgtggactccgtgaaggcgattcacatctcagagacaactcaaagacactctgtttcaccaaatgaacagcctgagaggcgagacacggcagtgtatactgtgcgagagatcgacatagaactaacggggaaagtcttttaggaattcgtacggtacggggacccaaaggggacctaacgtcgggtaccacccggttctccgtttacgaccgtccctaccgaaccgaaacgggtcccccaacgttcccggttacccttcccccgttggcccgtcccgtcgtcccgtccgacggaccg

SEQ ID NO: 386917 - DNA, 681 bp, Homo sapiens
  misc_feature: GZ8MTXP02HV8C5.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctctttttaagaggtgtccagtgtcaggtgcagctggtggagtcgtgggggagcgtggtccagcctgggaggtccctgagactctcctgtgcagcgtctggattcaccttcagtggctatggcatgcactggcctcccgcaggcctccggggcaaggggctgggaggtggggtggaccaagtttatagtagggttatggtataggggaaacgttaaataaaaggaccttaagtggtagggtaccgtccggtaggaaacggggtcccgagtttacccgaaccctaattccctaaccgaggaacgaaccaaaaccttacccgaaaacgtaaaccaactttaccttacggttttacctaacccctaaaattaccgaaactaacgtcccgttaggaacggacgggaccggaaacgggaaccgaacggggtaccaagggtttacgttaacgtttaaccgttgggttacggaaccggaaggtaacgtaacgttaccggaaaccgtagtttaccggtaaaaccgggg

SEQ ID NO: 386918 - DNA, 572 bp, Homo sapiens
  misc_feature: GZ8MTXP02GIKOZ.22.86.H09.1.454.CMB.2.raw
  modified_base (383)..(383): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactcgtgaaggccgatcacatctcagagacaactcaaagacactctcgtttacaccaaatgaacagctgagaggcgagacacggcagtgtattacgngtgcgagagatacgacatagaacgtaacggggaaatcttttgattcgtcgtaggggaccaaaggggacacgtcggtccaccgtctcgttacacgtccctaccaaccgaaacgggcccctaacggttcccggttccccttccccccgtaggggccccttcccccgtggtacccctaccggaacggtaccg

SEQ ID NO: 386919 - DNA, 615 bp, Homo sapiens
  misc_feature: GZ8MTXP02JFIKW.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgagttttcctcgttgcttcttttaagaggtgtccagtgtcaggtgcagctggtggagtcgtgggggagcgtggtccagcctgggagtccctgagactctcctgtgcagcgtctggattccaccttcagtggctagtggcatgccacgtggcctcccgccgagggcctccggggacgaaagggggcctaggggacggtggggtacggactaaagtttatagttggtaatgagttagggaaacgttaaagtaaaagcttaagtggtacggaccttccggtaggaacgggtccgtaatttcccgaacctactcctacccgaagacgaaccaaacctaccaaagaacctacttacttacgtttaccaaccaaaatcgaaactacgtaccgtagacgacgggacgaacggacgacggacgtaggtacgttaacttacgtaggtcgacgagagtactaccggaacgtagtaacgg

SEQ ID NO: 386920 - DNA, 597 bp, Homo sapiens
  misc_feature: GZ8MTXP02GDRS3.22.86.H09.1.454.CMB.2.raw
  modified_base (415)..(415): a, c, t, g, unknown or other
tcagacatacgcgtcacgaccggtgctcgatttagtgctatagacttgggtttgggctgagctgggttttcctcgttgctcttttaagaggtgtccagtgtcaggcgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactaatgtggactccgtgaaaggccgattcaccatctccagagacaaactccaaagaacactctgtttctccaaaatgaacaagacctgagaaggacgaggaacgaacggacgagtgtattaactagtgcgagaagaanacgacatagaacgtaaacggaaagtacgtttagtatactacgtacgggaccgaaacggaacgacgtacgtacgtaccgtactcttacctacgaccctacccaaacccgaaaccggacccgaaccgtaccgttacccgttcccccgtcccggtacccgtcccgtccgtccgtaccgacggacg

SEQ ID NO: 386921 - DNA, 508 bp, Homo sapiens
  misc_feature: GZ8MTXP02GPFD0.22.86.H09.1.454.CMB.2.raw
  modified_base (335)..(335): a, c, t, g, unknown or other
  modified_base (357)..(357): a, c, t, g, unknown or other
  modified_base (360)..(360): a, c, t, g, unknown or other
tcagacatacgcgtcacgaccggtgctcgatttagtgctatagacttgagctctgggagaggagcccagcactagaagtcggcggtgtttccattcggtgatcagcactgaacacaggggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcacttcagtggctatggcatgcactggctccgccaggctccgggcaaggggctggagtggggtgcaattanatggtatgatgggatataaagntangtgatcgtagaggccatcacatctccagagacaactaccaaagaacactctgtttctaccaaaatagaacaagacctagagaggacgacggaacgacggacgacgtagtacttactcgtgagaagagacacgacagacgacgtaacgg

SEQ ID NO: 386922 - DNA, 516 bp, Homo sapiens
  misc_feature: GZ8MTXP02FZ47V.22.86.H09.1.454.CMB.2.raw
  modified_base (502)..(502): a, c, t, g, unknown or other
tcagacatacgcgtcacgaccggtgctcgatttagtgctatagacttgggtttggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaacgcccccagactcatcattatgctgtcaataagcggccctcaggggtccctgatcgcttctctggctccaagtctggcaacccaccggcctccctgacccatctcgtgggcctccgaggctagaagatgaggctgattattactgctgctcatttgcaggcgcctacacgttgggtgttcgggcggagggaccaagcgtgaccgtctacggtcacgcccaaggctcgccccctcggtccaacgtcctcgtccccnccctcctcacgtcg

SEQ ID NO: 386923 - DNA, 596 bp, Homo sapiens
  misc_feature: GZ8MTXP02IR5CF.22.86.H09.1.454.CMB.2.raw
  modified_base (387)..(387): a, c, t, g, unknown or other
tcagacatacgcgtcacgaccggtgctcgatttagtgctatagacttgggtttgggctgagcgtggtttcctcgttagctctttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtggcaattatatggtatgatggaagtaataaagactatgtggactccgtgaaggccgagttcaccatctccagagacaactccaagaacactctcgtttctacaaatcgaactagctgagaggcgagacacggcagtgtatatggngagagagatacgacagtacgtaacgtaacggtagttacgttgtagacgttcggtacgggaccgtaacggacgtaccgtacgggtccgtacccgtacgttcctaccgtaccgtacccgtacccgaccggaacccggtacccgtaccgttacccggttccccgttccccgtccggtccccgtcccgtccgtacccgtacccgacggtaccg

SEQ ID NO: 386924 - DNA, 582 bp, Homo sapiens
  misc_feature: GZ8MTXP02GSQ04.22.86.H09.1.454.CMB.2.raw
  modified_base (312)..(312): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcacgtggcctccgcaggccgtccgggnaggggcgtggagtgggtggcctaagttatagtggtatgagtgggaaataaagtaaagactatggtcggactccggtaggaacgggccgtagttaccaccgtatccgtacagacgacaacgtaccaaagaacctacttccttacgtttcctaaccaaaattacgaaaccgtgacccgtaggaacggagggcgaaacggggaccgaacgggctaaggttagtacgttaacgtgtacggaacggtagacgactcggaactagtacgaaaccgg

SEQ ID NO: 386925 - DNA, 529 bp, Homo sapiens
  misc_feature: GZ8MTXP02H3KCM.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaaagacactctcgtttctccaaatgaacagcctgagaggcgagacacggcagtgtatactgtgcgagagatcgacatgactaacgggaaagtcttttagatctcgtggggacccaaggggacacgtggtcaccgtctcctttcacgccctccacgaacgggcccacgtccggtcttcccccgtggccgccctgcctccaggcg

SEQ ID NO: 386926 - DNA, 538 bp, Homo sapiens
  misc_feature: GZ8MTXP02GU62V.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaagtaataaagactatgtggactccgtgaaggccgatcacatctccagagacaactccaaagacactctcgtttcaccaaatgaacagcctgagaggcgagacacggcagtgtattactgtgcgagagatcgacagtgaacgtaagggaaatcgttttagatcgtcgtggggaccaaaggggacacgtcggcctaccgtctcttcacgcctcccaacgacggccctacgtcccggttcctcccccgtggccctcccgtcgcctccgaggaccg

SEQ ID NO: 386927 - DNA, 625 bp, Homo sapiens
  misc_feature: GZ8MTXP02JN5UN.22.86.H09.1.454.CMB.2.raw
  modified_base (200)..(200): a, c, t, g, unknown or other
  modified_base (208)..(208): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgtaggctcttttaagaggtgtccagtgtcaggtgcagctggtggngtgtgggnggcgtgtcgagcgtggcgtccgtgagactctccgtgtgcgcgtcgtcgtgtacttctacctcgtagtgtcgtagtcgtcgagtcgctacgtcgtccgtccgccgacggtccggtccgggacggtaacgggtcggtacgggtaggtcggggtacggtaccgtaagttaagttagtaggtagtagtaagtaggtaaagtaaagtaaagtaagtagtagtacgtacgtacgtacggtacggtacgtacgtactactactaccgtacgaacgtacgacgaactaacgaaacgaacgtacttacgttacgttactaactaaacgtaacgtaacgtacgacgtacgagacggacggacgacgacgacgtagtacgtacgtacgtacgtagaacgagaacgacgacgtacgtacgtacgtaacg

SEQ ID NO: 386928 - DNA, 565 bp, Homo sapiens
  misc_feature: GZ8MTXP02JWX27.22.86.H09.1.454.CMB.2.raw
  modified_base (313)..(313): a, c, t, g, unknown or other
  modified_base (326)..(326): a, c, t, g, unknown or other
  modified_base (342)..(342): a, c, t, g, unknown or other
  modified_base (346)..(346): a, c, t, g, unknown or other
  modified_base (366)..(366): a, c, t, g, unknown or other
  modified_base (377)..(377): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaataaataagactatgtggactcgtgaaggccgatcaccatctccaganacaactcaagacnctactcgttcacaatnaacngctgagaggcgagacacggnagtgtattacngtgcgagagatcgaactatagacgtaacgggaagtcttttacggatcgtcggtagggaccgaagggacctacgtcggaccgtaccgtcttccgttacgaccggtccctaccgaacccgaacgggtacccctacgttccggtccccttcccccgcggtcccgccccgttcgccctaccgaacggtcccg

SEQ ID NO: 386929 - DNA, 542 bp, Homo sapiens
  misc_feature: GZ8MTXP02IZXEF.22.86.H09.1.454.CMB.2.raw
  modified_base (314)..(314): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggcctccgccaggcctcccggggnaaggggctggggaggtggggtggacctaattatagtggtatgatgggaaataaataaagactagtgtgggactcgtgaagggccgtattccacatcctaccaagacgacaactaccaaagaacctacttcttcgtttactaccaaaatcgaaacagacctgaagaggacgaggactacgggcagtagtacttacgtgtagcgagagactacgactagtacgtaaacgg

SEQ ID NO: 386930 - DNA, 592 bp, Homo sapiens
  misc_feature: GZ8MTXP02GSV0N.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtggactcgtgaggcgatcacatctcagagacaactccaaagaacactctacgtttacctaccaaaatcgaacacgacctgaaggaggacgaggacgacggacagtgtattacgtgtgacgagagatacgacatagaacgtaaacggggaaattcgttttagaagttccgtacggtgggggacctaaggggactacggttcggtacctaccgtcgttacttacgaccggtccctacccgaaccgaaaccgggcccctacgtccggttcccttccccgtcggcccgtccctcggcctaccgaacggcccg

SEQ ID NO: 386931 - DNA, 644 bp, Homo sapiens
  misc_feature: GZ8MTXP02HBCB4.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcacgtggcctccgccgaggcctccggggcgaaggggctggggaggtggggtggactaagttagtagtggggtaatggaagttaggggaaagttaaagtaaaaggacgttaagtggtaggtaccgttaccgggtaggaaacggggccggtacttccgaaccctaagtcctacccaaggacggaaaccaaacgtaccaaaagaacctaactacttcgtttactacccaaatacgaaacgtacgtaccgtaggaacggacgggaccggaaacgggaaccaaccggggaccgtaggttaggtaactttaacgtcggttacgacggacggtaacggataaccgg

SEQ ID NO: 386932 - DNA, 570 bp, Homo sapiens
  misc_feature: GZ8MTXP02GZBLR.22.86.H09.1.454.CMB.2.raw
  modified_base (227)..(227): a, c, t, g, unknown or other
  modified_base (311)..(311): a, c, t, g, unknown or other
  modified_base (344)..(344): a, c, t, g, unknown or other
  modified_base (380)..(380): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaaataataaagactatgtgactcgtgaaggcgatcacatctcaganacaactccaaagacactctcgtttcaccaaatnaacagcctgagaggcgagacacggcagtgtattacngtagcgagagatcgacatagacgtaacgggaaagtcttttagacttcgtcggtacggggaccgaaagggacacgttcgggtccaccgttctcctttacgacgtcccttacccgaccgtaaacgggccccacgttcccgttacccgttccccccgttgggccccgtccctcggccttacccgacggacccg

SEQ ID NO: 386933 - DNA, 771 bp, Homo sapiens
  misc_feature: GZ8MTXP02JRT58.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtctggattcaccttcagtggctatggcatgcacgtggcctccgccaggccgtcccggggcgaaggggctaggggaggtggggtggaccctaagtttagtagttagggtatggtaataggggaaaagttaaagtaaaacggtacttaagttggtagggtaccgttacccggtagggtaaacgggggtcccgtacgtttacccaacccgtaacttcccgtaaccccgaaaggaaacggaaacccaaaacccttaaaccccgaaaacggtaaaccctaaccgtttacccgttacgtttttacccctaaacccctaaaagtttaaccgaaaaccgaacggtacccgttagggaaagggaacgggaccggggaaaaccgggttaaccggaaacccggggacgtaaacgggtttacggtttaaagtttaaacccggtttgggtacccgggtaacggtaacgggaaaacggttaacgtaccggggaaaaccctaacgggttaacggttaaaaacccggggg

SEQ ID NO: 386934 - DNA, 584 bp, Homo sapiens
  misc_feature: GZ8MTXP02H0L6K.22.86.H09.1.454.CMB.2.raw
  modified_base (283)..(283): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgnggactccgtgaaggccgattcaccatctccagagacaactccaaagaacactctcgtttctaccaaatgaacagcctgagaggacgaggaacacggcagtgtatactgtgcgaagagatcgacatgaactaacggggaaatcttttaggattcgtcgtagggggaccaaagggggacctaacgtgggttaccacccggttctcctttaccgacggtcccctacccgaacccgaaacggggtccccaacgttcccggtcccttcccccgtcggcccgcccctcgcccgtaccgacggacccg

SEQ ID NO: 386935 - DNA, 542 bp, Homo sapiens
  misc_feature: GZ8MTXP02JPJ3X.22.86.H09.1.454.CMB.2.raw
  modified_base (387)..(387): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaggcgattcaccatctcagagacaactccaaagaacactctcgttctaccaaatcgaacagcctgagaggcgagacacggcagtgtattacngtgcgagagatcgacagtagaacgtacgggaaatcttttagatctcgtggggaccaagggcacgtggtcctacgtctcgttcacgccctaccaaccgaacgggccccacgtcccggtccctcccccgtggcccgtccctcgcctccgacggaccc

SEQ ID NO: 386936 - DNA, 518 bp, Homo sapiens
  misc_feature: GZ8MTXP02FFEE0.22.86.H09.1.454.CMB.2.raw
  modified_base (253)..(253): a, c, t, g, unknown or other
  modified_base (394)..(394): a, c, t, g, unknown or other
  modified_base (470)..(470): a, c, t, g, unknown or other
  modified_base (472)..(472): a, c, t, g, unknown or other
  modified_base (508)..(508): a, c, t, g, unknown or other
  modified_base (512)..(512): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattanatggtatgatggaagtaataaagactatgtggactcgtgaaggccattcacatctccagagacaactccaaagaacactctcgtttctaccaaatcgaacagcctgagaggcgagacaggcagtgtattactgtgcgaganatcgaacatagacgtaagggaaagcttttagatcgtcgtggggacccaagggacacgtggtccaccgtctccttcncnccaccaccgacgccgctccgtcctcccgcgccgccncgcncgcgcg

SEQ ID NO: 386937 - DNA, 555 bp, Homo sapiens
  misc_feature: GZ8MTXP02JPJ06.22.86.H09.1.454.CMB.2.raw
  modified_base (526)..(526): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcaccatctccagagacaactccaaagaacactctcgtttctaccaaatgaacagcctgagaggcgagacacggcagtgtattactgtgcgagagatcgacagtagacgtacgggaaatctttgatctcgtagggaccctaaggggactacgtcggtaccaccgtctcttcacgtccctaccaaccgaaacgggccctaacgtcccggtaccctttcccccgnggccctcccgtcgccctaccgaggacccg

SEQ ID NO: 386938 - DNA, 663 bp, Homo sapiens
  misc_feature: GZ8MTXP02J0VIS.22.86.H09.1.454.CMB.2.raw
  modified_base (274)..(274): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctcctgtgcagcgtctggattcaccttnagtggctagtggcatgcacgtggcctcccggccgagggcccgtcccggggacgaagggggtcgtggggaggtggggtggacctaaagtttagtagtagggttataggaagtaggggaaaagtaaaacgtaaaagacgttaagttgggtacggtaacccgttacccgggtaggaaacggggtcccgtaatttcccgaacctaactccctacccgaaggaaacgaaccctaaaccgtacccaaaacgaacctacttcctttagtttaccctaaccgaaaatcgaaaaccacgtccgaggacggaacgggacggaacggaccgacgggactaaggttgttaacttacgtggtagaacggaagtaacgagtaccgacgagtacggtaaaccgg

SEQ ID NO: 386939 - DNA, 534 bp, Homo sapiens
  misc_feature: GZ8MTXP02IVVFC.22.86.H09.1.454.CMB.2.raw
  modified_base (227)..(227): a, c, t, g, unknown or other
  modified_base (521)..(521): a, c, t, g, unknown or other
  modified_base (529)..(529): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaaagtaataaagactatgtggactccgtgaaggcgatcacatctcagagacaactccaaagaacactctgtttaccaccaaatgaacacgcctgagaggcgagacacggcagtgtattacgtgtgacgagagatcgacagtagaacgtaacgggaaagtctttaggatcgtcggtaggggaccaaaggggactacgtggtccaccgtctcttcacgcctaccacgaacggcccactccgtcctcccgcgcctcccngcctacgngaccg

SEQ ID NO: 386940 - DNA, 529 bp, Homo sapiens
  misc_feature: GZ8MTXP02JVGUC.22.86.H09.1.454.CMB.2.raw
  modified_base (315)..(315): a, c, t, g, unknown or other
  modified_base (416)..(416): a, c, t, g, unknown or other
  modified_base (437)..(437): a, c, t, g, unknown or other
  modified_base (491)..(491): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagccgtggggaggtccctgagactctcctgtgcagcgtctggattcaccttcagtggctatggcatgcactggctccgccaggctccgggnaaggggctgggagtggggtggcctaattatatggtatggatggggaaagtaataaagcttatggtagggactccgaggtaaaggggccgaattcaccatcncagagacaactccaagaaccnctctgttaccaccaaatacgaacagcctgagacggcggacggacgaggcaggtntattacgtgtagcgagacgatcgacactaggaaaccgg

SEQ ID NO: 386941 - DNA, 530 bp, Homo sapiens
  misc_feature: GZ8MTXP02H0H3T.22.86.H09.1.454.CMB.2.raw
  modified_base (506)..(506): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtgcaattatatggtatgatggaagtaataaagactatgtggactccggtgaaggccgatcaccatctcagagacaactcaaagaacactctcgtttcaccaaatgaacagcctgagagcgagacacggcagtgtatactgtgcgagagatcgaacatgacgtaagggaaatctttagatcgtcgtagggaccaaagggcaacgtggtccaccgtctccttcacgtcccaccaaccgaacggccccagtccggtcccttccccgnggccgccctgcctaccgaggaccg

SEQ ID NO: 386942 - DNA, 617 bp, Homo sapiens
  misc_feature: GZ8MTXP02IRTM0.22.86.H09.1.454.CMB.2.raw
  modified_base (271)..(271): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagctctcctgtgcagcgtctggattcaccttnagtggctagtggcagtcgcacgtggcctcccgccgaggccgtcccggggacgaaggggctggggagtggggtaggacctaaagttagtagtaggtataggaagttagggaaagttaaactaaaaggacttagttgggacggtaccgtaccggtaggaaacggggtccctaattacccaccctaattccgacccaaggaacaccaaacctaccgaaaacgtaacctactttacttcgtttaccaacctaaagttcgaaacacgtcctaggaacggaggacgaacggactacgggactagtacgttaatcgtagcgaaggagacgtagtacgacgtagtacggaaacg

SEQ ID NO: 386943 - DNA, 549 bp, Homo sapiens
  misc_feature: GZ8MTXP02GNUJ3.22.86.H09.1.454.CMB.2.raw
  modified_base (393)..(393): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaataataaagactatgtggactccgtgaagggccgactcaccatctccagagacaactcaaagaacactctcgtttcaccaaatcgaacagcctgagaggcgagacgacggcagtgtattactgtgngagagactcgacatacgactaaacggggtaaatcttttaggaatcgtcggtacggggaccaaaggggacacggtgtaccgtacgtcttctcacgtccacccacgaacggccccagtccggttcctccccgtcggacctccctgacctcgaggaccg

SEQ ID NO: 386944 - DNA, 713 bp, Homo sapiens
  misc_feature: GZ8MTXP02H31KF.22.86.H09.1.454.CMB.2.raw
  modified_base (188)..(188): a, c, t, g, unknown or other
  modified_base (679)..(679): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcactggctccgccgaggcgtccgggagaaggggctggaggtgggtgactaattatagtggtatggagtaggtaaataaataaagactaagtggtacggtacctaccggtaggaacggccgtatccaacctatcctaccgaagacgaacctaacctacaaaacgtacctactcttccgtttaccaacctaaagtacgaacgtacgtacctgggaacggaacggaccggaaacggaacccgacgggtactaagggttacgttaacgttacggttaggtacggacggaaagtaacgtaacgtcgaaacgtaagtacggtaaaacggtaaggggtaaactttcgtttaaggacttcggtacgggtcggggaaaccaagggtacctacggtacggtaccctaaccgtcttacccccgttagaacccgttccccaacccgaaaccggaaccggtccctacgttcccgtccccttcccccggnggtaccccgtcccgtgccccgttacgaacgcccg

SEQ ID NO: 386945 - DNA, 529 bp, Homo sapiens
  misc_feature: GZ8MTXP02JUJA8.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcatcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctgtttctccaaatgaacagcctgagaggcgagacacggcagtgtattactgtgcgagagatcgacatgactacgggaaatctttgatctcgtggggccaaggggacacgtggtcaccgtctcttcacgcctccaccgaacgggcccacgtccggtccttcccccgtggccgtcccgtcgcctccgacggaccg

SEQ ID NO: 386946 - DNA, 720 bp, Homo sapiens
  misc_feature: GZ8MTXP02I3037.22.86.H09.1.454.CMB.2.raw
  modified_base (569)..(569): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcgagtcgtcgtgtcttaccgtaccttcgtaggtcgtacttaggtcggactagtcgaccgtacggtccggtccctccccggaccggacggtccccggggtacccggggaacggggtacggggtcggtaggggtaggggttcggggtacggaactttaaagttagttaggttagggttagtaggttaaggtaaggggtaaagttaaaacgtaaacgtagttagttagggtacgtaccggttaccgggaagggaaccggtcctactaacccactactccctaacggagaaaccacctaaccaacgaaactacctacgtttnttaccttaccaaactaagtaacgtaacacggttaccgagggaacgacggggaccgaagggaccgacggtagtaacggttattaaaccgtttggacggtcggaaacggtaagtaacgtacgtaccggaaactagggtaccgtaaaacggggg

SEQ ID NO: 386947 - DNA, 504 bp, Homo sapiens
  misc_feature: GZ8MTXP02IMR28.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctctttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggcaaggggctggagtgggtggcaattatatggtatgatgggaaataataaagactagtgtggactcgtgaaggccgattcacatctcagagacaactacaaagaacactctgtttacaccaaatcgaacagcctagagaggcgaggacaggcaagtcgtatacgtgtgcgagagactacgactagtacgtaacgg

SEQ ID NO: 386948 - DNA, 566 bp, Homo sapiens
  misc_feature: GZ8MTXP02JP1PB.22.86.H09.1.454.CMB.2.raw
  modified_base (277)..(277): a, c, t, g, unknown or other
  modified_base (354)..(354): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggctaaattatatggtatgatggaaagtaaanaaagactatgtgactcgtagaggcgattcacatctccagagacaactaccaaagaacactctcgttaccaccaaatnaacagcctgagaggcgagacacggcagtgtattacgtgtgacgagagactcgacatgaacgtaacgggaaatctttagatcgtcggtgggaccaagggactacgtggtacctaccgtctccgttcaccgtccctaccgaaccgaacgggcccctacgttccccgtcccttcccccgcggcccgtcccgtcgtccctccggaacggtaccccg

SEQ ID NO: 386949 - DNA, 562 bp, Homo sapiens
  misc_feature: GZ8MTXP02GTY66.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtggctatggcatgcactggctccgcaggctccgggcaggggctgggagtggggtgcctaattatagtggtatggaatggggaaattaaataaaggacttagtggtggactccggtagaacggggccattcacctatcctccagacgacaactaccaaagaaaccacttctacgtttaccacctaaatacgaaacacgacctggaacgacgggacgaagggaccgacgggactaggtagttacgttacgtggtacggaacggaagacgactacgaactagtacggtaaacgg

SEQ ID NO: 386950 - DNA, 588 bp, Homo sapiens
  misc_feature: GZ8MTXP02IUE3I.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctcctgtgcagcgtctggattcaccttcagtggctatggcatgcacgtggcctcccgccgaggccgtcccggggcgaaggggcctggggaggtggggtggacctaagttagtagtggttatggaatggggaaagttaaataaaagacttagtggtacgggaccgtccggtaggaacgggtccgattccgacctatcctacgagaacgacaactaccaaacgaaccacgttcttacgtttactaacccaaatcgaaacagaccgtaggaacggaggcggaacggacgacggctagtacgttacttacgtgtacgaagagagactacggactagtacgtaacgg

SEQ ID NO: 386951 - DNA, 540 bp, Homo sapiens
  misc_feature: GZ8MTXP02HP9NW.22.86.H09.1.454.CMB.2.raw
  modified_base (468)..(468): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctcgtttcaccaaatcgaacagcctggagaggcgaggacacggcagtgtattactgtagcgagagatcgacatgaactaaggggaaattcttttaggatcgtcgtggggaccaagggacacgtcggcaccgtntacttcacgtcctccaccgaacggcccacgtccgtccttccccgcggccgtcccgtcgcctccgaggacccg

SEQ ID NO: 386952 - DNA, 514 bp, Homo sapiens
  misc_feature: GZ8MTXP02FQMYO.22.86.H09.1.454.CMB.2.raw
  modified_base (340)..(340): a, c, t, g, unknown or other
  modified_base (501)..(501): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctccgccaggcctccggggcaaggggctgggagtggggtgcctaattanatggtatggatgggaaagtaataaagactatgtggactccgtagaagggccgattcacatctccagacgacaactaccaaagaacactctacgtttctaccaaatacgaacagcctgagaggacgacggacgacggcagtgtactacgtgtgcgagagacncgacagtcgaacg

SEQ ID NO: 386953 - DNA, 545 bp, Homo sapiens
  misc_feature: GZ8MTXP02I8SM3.22.86.H09.1.454.CMB.2.raw
  modified_base (206)..(206): a, c, t, g, unknown or other
  modified_base (240)..(240): a, c, t, g, unknown or other
  modified_base (322)..(322): a, c, t, g, unknown or other
  modified_base (362)..(362): a, c, t, g, unknown or other
  modified_base (413)..(413): a, c, t, g, unknown or other
  modified_base (419)..(419): a, c, t, g, unknown or other
  modified_base (536)..(536): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtnatgttggtgttataactatgtctctggtaccaangcacccaggcaaacgccccagactcatctatttatgctgtacaaataagccggccctcgacggggtccctgactcgtcttcncgtcggctccaagtctcggacacaccggcctcctcgaccntctcgtggcctccgaggctagaagatgaggctagatttagtactgctgctntatttncgaggtcgacctacgacgttcgggtcggttcgggcggaacgggaccaacgtcttacggaccgtccgttaggcaacgccgtaacgccgtccgccccctggtcacttcgccgttccccncctcctccg

SEQ ID NO: 386954 - DNA, 532 bp, Homo sapiens
  misc_feature: GZ8MTXP02G0HYC.22.86.H09.1.454.CMB.2.raw
  modified_base (384)..(384): a, c, t, g, unknown or other
  modified_base (450)..(450): a, c, t, g, unknown or other
  modified_base (522)..(522): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaggcgatcacatctcagagacaactccaaagaacactctgtttcaccaaatgaacagcctgagaggcgaggacacggcagtgtattacngtgcgagagatcgacagtagacgtacgggaaatcttttagatcgtcgtggggacccaaaggggacncgtggtcaccgtctcttcacgcctccaccgaacggcccacgtccggtccttccccgtggcccgccctgtccnccgagacccg

SEQ ID NO: 386955 - DNA, 624 bp, Homo sapiens
  misc_feature: GZ8MTXP02HHWXA.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggcctccgccaggctccgggcaaggggctgggagtgggtgacaagttatatggtatgagtaggaaagtaataaagactataggtggactccggtagaacgggcctagttccaacctatcctaccaagtaacgacaactaccaaagtaaccacttcttacgtttacaccaaatacgaaactacgcctggaagacggacggagaccgacggctaggtagtacttacgtgaggacgaagaagacgtaccgaagtatacggaaacggtaaacggggtaaacttcgttttacggaattcgtacgggtacggggaaccgtaaagggacctaacgtcggtacctaccgtctacgttcacgtcccaccgaccgacggccctacgtcccgtctccccgtcgccgtcccgtgacctcgaacggccg

SEQ ID NO: 386956 - DNA, 585 bp, Homo sapiens
  misc_feature: GZ8MTXP02GJ3J8.22.86.H09.1.454.CMB.2.raw
  modified_base (240)..(240): a, c, t, g, unknown or other
  modified_base (272)..(272): a, c, t, g, unknown or other
  modified_base (352)..(352): a, c, t, g, unknown or other
  modified_base (421)..(421): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctgtaccaangcaccaggcaaagccccagactcatcatttangctgtacaataagcggccctcgaggggtcccctgactcgcttctctggctccaagtctggcaacacggccctcctgaccntcctcgtcgggcctccgaggctagaaagatgaggctgtattatactgcttgctctatttgcacgggtcncctacgtacgttgggtgttcggggacggaacgggaccaaggtcgtacgacccggttccgttaacggtccaacggaccccgaaacggtccccgtccggtacccccccgttcgggtccctaaccgttcccttacccggtttcccctaacccccttcccgttacccg

SEQ ID NO: 386957 - DNA, 664 bp, Homo sapiens
  misc_feature: GZ8MTXP02JRWJX.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggtccagccgtgggacgtccctgacgctctcctgtcgcagcgtctggtacttccaccttcgagtggctagtcggactatcgctacgtcggcctccgccgacgggccgtaccggggacggaacggggtcgtaggggtacggtggggtacgaaccgttaaagtttagttaggttagggttaagtaggtaagttaggggtaaaacgttaaagtaaaacgtacgttaagttgggtacgtaccgtacggtacggaacggtaccgtataccgactacttccacgaacgacgtaaaccaacgtaacccaaagtacccttacttacgttacgtttaccaaccgtaaagttacgacgacgtaccgtaggaacggacggacgtaacggaccggagtactaggttagttactacgtggtacgaagtaacgagactacgtacgtagaacggttaacgg

SEQ ID NO: 386958 - DNA, 519 bp, Homo sapiens
  misc_feature: GZ8MTXP02JIZC4.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctcccgggcaaggggctgggagtggggtgcaattatatggtatgatgggaaagtaaataaagctatgtggactccgtgaagggccgattcgaccatctccagagacaaactcccaaagaacacttactgtttacctaccaaaatgaacaggcctaggacgaggcgacggacacggacaggtgtatacgtgtgaacgagacgatcgacagtcgaacg

SEQ ID NO: 386959 - DNA, 554 bp, Homo sapiens
  misc_feature: GZ8MTXP02I3L3L.22.86.H09.1.454.CMB.2.raw
  modified_base (240)..(240): a, c, t, g, unknown or other
  modified_base (358)..(358): a, c, t, g, unknown or other
  modified_base (383)..(383): a, c, t, g, unknown or other
  modified_base (400)..(400): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaangcaccaggcaaacgccccagactcatcatttatgctgtacaataacgccggtccctcgacggggtccctgactcgtcttctctggctccaagtctcggacaacacgcctcctcgaccntctcgtggcctccgaggctagaagntgagctgtattattacngtctgctctatttcgcgaggtctcctagtacgttggggtcgttcgggcggtaacgggaccaagtccgtcggacccgtacgtacggcaacgcccgtaacggcctccggcccccgtcggtcctaccgtccgtccggttccccgtcccttcctcccg

SEQ ID NO: 386960 - DNA, 626 bp, Homo sapiens
  misc_feature: GZ8MTXP02JIIC4.22.86.H09.1.454.CMB.2.raw
  modified_base (227)..(227): a, c, t, g, unknown or other
  modified_base (388)..(388): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggaggtgggtggctaattatatggtatgatggaaagtaataaagactatgtggactccgtgaaggccgattcacatctcagagacaactcaaagacactctcgtttcaccaaatgaacagcctgagaggcgagacacgcagtagtattacgngtgcgagagatcgaacagtagaacgtaaacgggggaaaattcgttttagacgttaccgttacgggtacgggggacccgaaaagggggacctaacggttcgggttaccctaccggttccttcctttaccgaacggccccttaacccgaaacccgaacggggaccccctaacgttccccgggttacccttcccccgtcggggtaccccgtccccgtcgcccctacccggagggtaacccg

SEQ ID NO: 386961 - DNA, 623 bp, Homo sapiens
  misc_feature: GZ8MTXP02FU6T3.22.86.H09.1.454.CMB.2.raw
  modified_base (225)..(225): a, c, t, g, unknown or other
  modified_base (252)..(252): a, c, t, g, unknown or other
  modified_base (385)..(385): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggagtccctgagactctcctgtgcaggcgtctggattcaccttcagtggctatggcatgcactggctcgccaggctccgggnaaggggctgggagtgggtggctaattntatggtatgatggaagtaataagactatgtggactcgtgaaggccgattcacatctcagagacaactcaagacactctcgtttcctaccaaatgaacacgcctgagaggcgaggacacggcagtcgtattacngtgacgagagatcgacatagacgtaacggggaaatcgttttagacttcgtacggttacgggggacccaagggggacctacggttacgggtacccaacccggttcttaccttcaccggtacccttacccgaaaccgaaaccggggtcccctaacggttccccgggtttacccttaacccccccggttcgggcccccgttaccccgttccggacccgttacccggaacgggtaaccccgg

SEQ ID NO: 386962 - DNA, 545 bp, Homo sapiens
  misc_feature: GZ8MTXP02GU7HS.22.86.H09.1.454.CMB.2.raw
  modified_base (227)..(227): a, c, t, g, unknown or other
  modified_base (380)..(380): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtgcaattatatggtatgatggaagtaataaagactatgtgactcgtgaaggccgattcaccatctcagagacactccaagacactctcgtttcacaaatgaacagctgacgaggcgagacacggcagtgtattacgngtgcgagagactcgacagtagacgtaacgggaaatctttagatcgtcgtgggaccaaggggactacggtgtaccaccgttctcgttcacgtccctaccgaaccgaacgggtccctacgtccggttcctcccccgtcggccgcccgttcgcctacccgagggaccg

SEQ ID NO: 386963 - DNA, 559 bp, Homo sapiens
  misc_feature: GZ8MTXP02G9EJD.22.86.H09.1.454.CMB.2.raw
  modified_base (224)..(224): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctcgggnaaggggctggagtgggtggcaattatatggtatgatggaataaataaagactatgtggactccgtgaaggccgattcacatctcagagacaactcaaagacactctcgtttcaccaaatgaacagctgagaggcgagacacggcagtgtattacgtgtgacgagagatcgacagtgactaacgggaaatcgttttagatctacggtacggggaccaaaggggcaacgtcggtaccaccgttctccgtttcgacgccctacccgaaccgtaacgggccctacgtccggttaccctcccccgtcggcccgtcccgtcgccctaccggacgggacccg

SEQ ID NO: 386964 - DNA, 658 bp, Homo sapiens
  misc_feature: GZ8MTXP02IKQLS.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggccgtccgggcgaaggggctgggaggtgggtggactaattatagtggtatgataggaaataataagactatgtaggactcggtaggacggctatcaccatcacagacgacaactaccaaagactactctcgtttaccacctaaatacgaacagacctggagaggacggaacgaccgacgggactaggtagttataccgtgtacgacgaagagtactacgactagtacgaacgttaaacggggaaatttccgtttagacgttcgacgggtacggggaccgaaagggtactacggttcggaccttaccggttcttaccgttaccgaccgttacccccgtaccggaaaacccggaaccggggtccccctaaacggtttccccgttcccccgttcccccggtcggccccgtcccgtcggtaccctacccggaaggtaaccccg

SEQ ID NO: 386965 - DNA, 569 bp, Homo sapiens
  misc_feature: GZ8MTXP02I8JL2.22.86.H09.1.454.CMB.2.raw
  modified_base (389)..(389): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggcgattcacatctcagagacaactccaagaacactctgtttccacctaaatagaacacgcctgagaggcgaggacacggacagtagtattacngtgcgaagagactacgacatagaacgtaacggggaaaattcgttttagattccgtggtacggggacccgaagggacacgtcggtcaccgtcttcctacgcgtccctaccaaccgtaaacgggcccctacttcccgggtcccttcccccggtggcccgtcccgtcgcctccgacggacccg

SEQ ID NO: 386966 - DNA, 541 bp, Homo sapiens
  misc_feature: GZ8MTXP02GZ2XP.22.86.H09.1.454.CMB.2.raw
  modified_base (227)..(227): a, c, t, g, unknown or other
  modified_base (519)..(519): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaagtaataaagactatgtggactccgtgaaggccgatcacatctccagagacaactccaaagacactctacgtttcaccaaatcgaacagcctgagaggcgagacacggcagtagtattacgtgtgcgaagagatcgaacagtgaacgtaacgggaaatcttttaggaatcgtcggtacggggaccaaagggacacgtcgtacaccgtctacgttcacgccctaccacgacggcctacgtccggtcctccccgngccgccctgcctccgacgaccg

SEQ ID NO: 386967 - DNA, 639 bp, Homo sapiens
  misc_feature: GZ8MTXP02I4X87.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacgactctcctgtgcagcgtctggattcaccttcagtggctatggcatgcactggcctcccgcagggccgtcccggggcgaaggggctgggaggtggggtggccaaattagtatggtatggatgggaaataaataaagacttagtggtaggacgttccggtaggtaaacgggccgtaagttccaacctatcccgtacccgaagaacgaaccaaacctaccgaaaacgtaaaccactttaccgttacgttttaccctaccctaaaacgttcggaaacctacgacccgttaggaacgggacgggacggaacgggaaccgaaccggggtcgtaaacggtagtttaacgttaaccgtggttaggcggaaggtaggaacgttacggaaactagtacggtaaaaccgg

SEQ ID NO: 386968 - DNA, 595 bp, Homo sapiens
  misc_feature: GZ8MTXP02G7BX5.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggagcgtggtccagccgtgggaggtccctgagactctcctgtgcagcgtctggattcaccttcagtggctatggcagtgcactcggcctcccggccgaggccgtccggggcgaaggggctggggaggtgggtgcaattagtagtggtatggagtaggaaagttaagtaaagactaagtgtaggtactccggtaggaacggggtccgtactaccaccgtatccgtaccgaaagacgtaaccaaaccttaccgaaagaacctacgttccttagtttaccacctaaagtcgaaacacgcctaggacggaggacggaacggaccgacggcaaggttataacgttacgtgtacggcgtagacgagtaacg

SEQ ID NO: 386969 - DNA, 543 bp, Homo sapiens
  misc_feature: GZ8MTXP02HIN1B.22.86.H09.1.454.CMB.2.raw
  modified_base (514)..(514): a, c, t, g, unknown or other
  modified_base (528)..(528): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtggcaatatatggtatgatgggaaataaataaagactaatggtaggactaccgtgaaacgggcccgaattccaaccctatcctaccaagacgaacaaacctaccaaagaaactacttacttcgtttactaacccaaaatcgaaacaacgcctagaagaggacgaaggacacgggcaggtctattacngtgaacgagagtancgaacagtacgaacg

SEQ ID NO: 386970 - DNA, 594 bp, Homo sapiens
  misc_feature: GZ8MTXP02J11BS.22.86.H09.1.454.CMB.2.raw
  modified_base (336)..(336): a, c, t, g, unknown or other
  modified_base (369)..(369): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctccgccaggcctcggggcaaggggctggagtggggtgccaattntagtggtatcggatgggaaacgtaaataaacgntagtggtaggactccgtaggaagggccgtattaccaccgtatcctccgaagacgaacctaaactcccgaaaagaacccaacttccgttagtttacctaaccctaaaagtcgtaaaccacggtcccttagggaacggacgggaccggaacgggaccacgggcctaaggttcggtaattaccgtggtaggcgaaggaagtacgtaccggactaagtacgtaaaccgg

SEQ ID NO: 386971 - DNA, 648 bp, Homo sapiens
  misc_feature: GZ8MTXP02HLRJX.22.86.H09.1.454.CMB.2.raw
  modified_base (407)..(407): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgataggaaagtaaataaagactatgtaggactccgtagaaggcgatcaccatctcagagacaactaccaaagaacactcttacgtttacctaccaaatacgaaacacgcctgagaggacgaggacgacggctagtagtattacgtgngacgagagactcgaacagtagaacgtaaaggggaaattcttttagaacttcgtacgggtacgggggaccaaaggggacctacggttacggtacccgtaccgttccttaccgtttaccgaccggttacccctaccccgtaaaccggggaaacccggtcccgtaaccgttccccggggttacccccttccccccgggtcggtcccccgtcccgtccgtaccccgtaccggaacgggacccccg

SEQ ID NO: 386972 - DNA, 558 bp, Homo sapiens
  misc_feature: GZ8MTXP02JX16X.22.86.H09.1.454.CMB.2.raw
  modified_base (405)..(405): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtggctaattatatggtatgatggaagtaaataaagactatgtggactccgtagaagggccgattcaccatctcagagacaactcaaagacactctcgttcacaaatgaacagcctgagaggcgaggacacggcagtgtattacgtgtgcgagagatcganatgaacgtaagggaaagtcttttgactctcggtgggaccgaagggacacgtcggtaccaccgtctcgttaccacgccctaccgaaccgaccgggaccctacgtcccggttcccttcccccgcggtcccgcccttcgaccgtccgacggacccg

SEQ ID NO: 386973 - DNA, 584 bp, Homo sapiens
  misc_feature: GZ8MTXP02HFT4O.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtgcaattatatggtatgatggaaagtaaataaagactagtggtggactccggtggaacgggccgattcaaccagtcctaccagacgaccaaactccaaagaaccacttctgtttaccaccaaatacgaacagcctggaagaggaccgaggacacggactagtagtacttacgtgtagacgagagactcgacaagtagaacgtaacgggaaattcgtttagatcgtcgtacggggaccaaggggacacgtgtaccgtccgtctcttcacgccctccgaaccgacggccctacgtccgttcccgtccccgtcggcccgtacctcgcccgtaccgacggtccg

SEQ ID NO: 386974 - DNA, 598 bp, Homo sapiens
  misc_feature: GZ8MTXP02IXD1F.22.86.H09.1.454.CMB.2.raw
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaaggccgattcaccatctccagagacaactccaaagaacactctcgtttctaccaaatgaacagcctggagaggcgagacacggcagtgtattactgtgcgagagatacgactaagtgaacgttaaacggggaaaagtcgtttttaggatttcgtcggttacgggggacccgaaagggggtacaacgttgggtacctaccgttcctaccgtttacgacgcccttacccaaccgaaaccgggccctacgtcccgggttccttcccccgtcggcccgtccccgtcgtccgtacccgaacggcccg

SEQ ID NO: 386975 - DNA, 543 bp, Homo sapiens
  misc_feature: GZ8MTXP02IO9KL.22.86.H09.1.454.CMB.2.raw
  modified_base (327)..(327): a, c, t, g, unknown or other
  modified_base (344)..(344): a, c, t, g, unknown or other
  modified_base (353)..(353): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcacttcagtggctatggcatgcactggctccgcaggctccgggnaaggggctggagtgggngacaattanagtggtatgatggaaagtaaataaagactatgtggactccggtaggaagggccgattacgaaccatcctccaagacgaacaactccaaagaacactactcgtttactacctaaatagaaacagacctagaggaggaccgaaaggacgacggacgtagtagtaacttaacgcggtagacgagagacgtacg

SEQ ID NO: 386976 - DNA, 578 bp, Homo sapiens
  misc_feature: GZ8MTXP02FYXGB.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactcgtgaagggccgattcacatctccagagacaactccaaagaacactctcgtttcaccaaaatgaaacagcctgagaggcgaggacacggcagtgtattactgtgcgagagatcgacatagacgtaaacgggaaagtctttttaggatcgtcgtggggaccctaaaggggactacgtcgggtccaaccggttctcttccacgtccctacccaaccgaacgggcccctaacgtcccgggttcccttccccccgtcgggccccgtccccgttgcccgtaccgacggacccg

SEQ ID NO: 386977 - DNA, 603 bp, Homo sapiens
  misc_feature: GZ8MTXP02FL2KT.22.86.H09.1.454.CMB.2.raw
  modified_base (387)..(387): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactcgtgaaggcgatcacatctcagagacaactccaaagaacactctcgtttctaccaaatgaacagcctggagaggcgagacgacggcagtgtattacngtgcgaagagatcgacatagacgtaacggggtaaagtcttttggattcgtacggttgggggacccgtaaaggggacctaacggttcggtaccgtaaccggttcttcccgttacacggtacccctaccgaacccgaaacggggccccctaacggtcccggtttcccgttccccccgtcggtaccccgtcccgttcgacccgttccgaacgggacccg

SEQ ID NO: 386978 - DNA, 545 bp, Homo sapiens
  misc_feature: GZ8MTXP02JBPOF.22.86.H09.1.454.CMB.2.raw
  modified_base (253)..(253): a, c, t, g, unknown or other
  modified_base (378)..(378): a, c, t, g, unknown or other
  modified_base (385)..(385): a, c, t, g, unknown or other
  modified_base (402)..(402): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattanatggtatgatggaagtaataaagactaatgtggactccgtgaaggccgattcacatctcagagacaactccaagaacactctgtttctaccaaatgaacagcctgagaggcgagacacggcagtntattacngtgcgagagatcgacangaacgtaacgggaaagtcttttgatctagtcggggaccaaaggggacacgtggtcaccgtctcgtcacgtccctaccgaaccgaaacgggcccctacgtcccggttccttcccccgtggccgcccctggacctccgaaggccc

SEQ ID NO: 386979 - DNA, 561 bp, Homo sapiens
  misc_feature: GZ8MTXP02FSOD7.22.86.H09.1.454.CMB.2.raw
  modified_base (345)..(345): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctggggagtccctgagctctcctgtgcagcgtctggattcaccttcagtggctatggcatgcactggctccgcaggctccgggcaaggggctggagtggggtggccaattatatggtangatgggaaataataaagactatgtggactccgtgaaggcgatcacatctaccagagacaactaccaaagaacacctacttcgtttacctaccctaaaatcgaaaccagaccctaggacggaacgggacggaacgggaccaacggggaccaggttagtaacgtttaacgtggtacggaacggaggaaggacttacggaacagtacggtaaaaccggg

SEQ ID NO: 386980 - DNA, 537 bp, Homo sapiens
  misc_feature: GZ8MTXP02ISKRD.22.86.H09.1.454.CMB.2.raw
  modified_base (334)..(334): a, c, t, g, unknown or other
  modified_base (393)..(393): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaaggggctggagtgggtggcaattatatggtatgatggaagtaataagactatgtgactcgtgaaggcgattcacatctccagagacaactccaagacactctgttcnccaaatgaacagcctgagaggcgagacaggcagtgtattactgtgcgagagatcgacangactaacgggaaatcgttttgattctcgtaggggacccaagggcagtcggtccaccgtctcttacacggtccctaccgaaccgaacgggtccccagtcccggttccttcccccgtcggcccgccccgtgccctccgaacggccg

SEQ ID NO: 386981 - DNA, 553 bp, Homo sapiens
  misc_feature: GZ8MTXP02GW6VX.22.86.H09.1.454.CMB.2.raw
  modified_base (421)..(421): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggaggtccctgagactctcctgtgcagcgtctggattcaccttcagtgctagtggcatgcacgtggcctccgccgaggccgtccggggcaagggggctggggaggtggggtgacctaaatttagtagtggtatgaatgggaaattaaataaagactagtgtagacctcgtagaacggcgtatcactatccncaagacacaactacaagaactactactcgtttacctaccaaatacgaaacagacctaggacgacggacggaacggacacggtacagttacgtacttacgtgtagaagagagactacgactacgtagaaacgg

SEQ ID NO: 386982 - DNA, 514 bp, Homo sapiens
  misc_feature: GZ8MTXP02IYXS8.22.86.H09.1.454.CMB.2.raw
  modified_base (341)..(341): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggctggagtgggtggcaattatatggtatgatggaagtaataaagactatgtggactccgtgaaggccgattcaccatctccagagacaactccaaagacactctgtttcnccaaatgaacagcctgagaggcgagacacggcagtgtattactgtgcgagagatcgacatgaactacggggaaatctttagatctcgtggggaccaaggggacacgtggcacgtctctcagcctacaccaacggcccactccggtctccccgtgcctccctgacctcgagacg

SEQ ID NO: 386983 - DNA, 691 bp, Homo sapiens
  misc_feature: GZ8MTXP02JZ3PW.22.86.H09.1.454.CMB.2.raw
  modified_base (226)..(226): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctgggagtgggtggctaattatagtggtatgagtggaaagtaaataaagactagtggtaggactccgtaggaagggccgtattcaccatctaccagacgacaactccaaagaaccactctcgtttaccacaaatacaacagcctgaggacggcgagacgacggacagttagtaacttacgtgtaggacggtaagagtactcggaactagtacgaacgttaaacggggtaaacttcgttttagacgttacggtacgggtacgggggaacccgaaacggggtaaccgtaccggttccgggtaacccgtaccccggttccttacccgtttacccgaaccgggtcccccttacccggaaaccccggtaacccggggtacccctaccggttaccccggtttccccgttccccccggttggacccccgtcccggttaccgcccgttaccccggacggtaccccgg

SEQ ID NO: 386984 - DNA, 550 bp, Homo sapiens
  misc_feature: GZ8MTXP02HM91H.22.86.H09.1.454.CMB.2.raw
  modified_base (399)..(399): a, c, t, g, unknown or other
  modified_base (405)..(405): a, c, t, g, unknown or other
  modified_base (522)..(522): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaaataaagactatgtggactccgtgaaggccgattcaccatctccagacgacaactaccaaagaacactctcgtttcaccaaatgaacagcctgagaggcgagacgacgcagtgtatactgtgacgaganatcganatcgacgtaagggaaatctttagatcgtcgtggggaccaaagggcacgtggcctaccgtctcttacacgtcctacccgaaacgtacgggccctacgttcccggtccctttcccccgnggccctacccgtgccctccgaggacccg

SEQ ID NO: 386985 - DNA, 685 bp, Homo sapiens
  misc_feature: GZ8MTXP02HNEH1.22.86.H09.1.454.CMB.2.raw
  modified_base (188)..(188): a, c, t, g, unknown or other
  modified_base (227)..(227): a, c, t, g, unknown or other
  modified_base (239)..(239): a, c, t, g, unknown or other
  modified_base (248)..(248): a, c, t, g, unknown or other
tcagacatacgcgtcacgaccggtgctcgatttagtgctatagacttgggtttgggctgagcgtgggtttcctcgttgctcttttaagaggtgtccagtgtcaggtgcagctggtggagtctggggggagcgtggtccagcctgggaggtccctgagactctcctgtgcagcgtctggattcaccttnagtggctatggcatgcactggctccgccaggctccgggnaaggggcgtggnggtggtganaattatagtgtagtagagtaggaaagtaaagtaaagtaactagtagtaggtacgtaccggtaggaacgggaccgtacgtacaacctactactaccgaacgaacgaaacaaacctaaccaaacgaaactaacctacttaccgtttacctaacctaaactaacgtaacgaacgacgtacgaggaacggacggacggaacgacggacgagtagttagttacgtagtagagagagagtacgacgagtacgaacgtaaacggtaaacgttacgtttagttagttacgtacggtacgggacggaacggacgtacgtacggtaccgtaccgtactacgttacgtacgtacccgtacccgaacccgaaccggtacccgtaccgtacccggttacccgttcccccgtcccggtacccggtcccgtccgtaccgtaccgacggaccg

SEQ ID NO: 386986 - DNA, 629 bp, Homo sapiens
  misc_feature: GZ8MTXP02FTX9N.22.86.H09.1.454.CMB.2.raw
  modified_base (290)..(290): a, c, t, g, unknown or other
  modified_base (335)..(335): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttnagtggctatggcatgcacgtggcctcccgccagggcctccggggnaaggggctgggaggtggggtgactaaattatagtgggtatggaagtagggaaagttaaataaagacttaagtgtaggactaccggtaggaaacggggtccgactttacaacctatacctaccgaaaggaacgaaaccaaactaccgaaaacgaaacctacttaccttacgtttacctaacccgtaaaattacgaaacacgtacccgtaaggacggagggaccggaaacgggacgaaccggggtactaaggttagtaagtttaccgtaggtcggacggaggaacgtagtaaccgg

SEQ ID NO: 386987 - DNA, 576 bp, Homo sapiens
  misc_feature: GZ8MTXP02FRLO5.22.86.H09.1.454.CMB.2.raw
  modified_base (278)..(278): a, c, t, g, unknown or other
  modified_base (375)..(375): a, c, t, g, unknown or other
  modified_base (407)..(407): a, c, t, g, unknown or other
  modified_base (439)..(439): a, c, t, g, unknown or other
  modified_base (463)..(463): a, c, t, g, unknown or other
  modified_base (474)..(474): a, c, t, g, unknown or other
  modified_base (486)..(486): a, c, t, g, unknown or other
  modified_base (492)..(492): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcgtggtttctcgttgctctttaagaggtgtccagtgtcaggtgcagctggtggagtcgtgggggaggcgtggtccagcctggggaggtccctgagactctcctgtgcagcgtcnggattcaccttcagtgctagtggcatgcacgtggcctcccgccgagggtcctaccggggcaaaggggcctggggaggtggggttaggactaaagttntagtggtatggagtaggaaataaacgtaaagntagtgtgactcgtagacgggtccattccacanctacagacgaaccaactccgaaanaactactcttnttaccactaaancgaacncgacgaggaggacggacggtaacggacgtacggtacgtaggttacgtaacgttacggtggtacggacggtaagacggtactacg

SEQ ID NO: 386988 - DNA, 709 bp, Homo sapiens
  misc_feature: GZ8MTXP02H3UKL.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggaggtccctgagactctcctgtgcagcgtctggattcaccttcagtggctatggcatgcactggctccgccaggcctcggggcaaggggctggggaggtggggtgacctaaattagtagtgggtatgatgggaaagttaaactaaagtactagtggtagtaacctcccggtaggaaacgggggtcccgtaagtttacccgaacccgttaattcccgttaccccgaaaggggaaccgtaaacccgaaaacccttacccccgaaaacggaaaccctaaccgtttacctttacggttttaccctaaacccgtaaaaagttaccgaaaaacccgttacggaccccgttaaggggaaccggtaaggggaaccccgggtaaagggaaacccggtaccgggacctaagggttacgttaaacgttaccgtgggttacggaacggtaacggtaacgagttaccgaacgtaggttacgtaaacccggg

SEQ ID NO: 386989 - DNA, 648 bp, Homo sapiens
  misc_feature: GZ8MTXP02IPQDJ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggacggtccctgacgactctcctgtgcagcgtctggacttcaccttcagtggctagtggcatgcacgtggcctccgccgacggccggtcccgggcggaaggggctggggaggtggggtgacctaaagtttagtagtggtatagaagtaggggaaagttaaactaaagacttagttaggtagggtaacctccgggtagaaacggggtccctaattccgaaaccctactttccgacccgaaaggaacgtaacccaaacctacccgaaaagtaacctactttcgttacgttttaccaaccctaaaagttcgaaacctacggtaccgtaggaaaggacggacggaacggaccgacgggtactaaggttagttaacttaccgtaggtcgaacgagtagtacaacgactaagtacgtaaaccgg

SEQ ID NO: 386990 - DNA, 559 bp, Homo sapiens
  misc_feature: GZ8MTXP02JZ9R3.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactcgtgaaggcgatcacatctccagagacaactccaaagaacactctcgtttctaccaaatgaacagcctgagaggcgaggacacggcagtgtaattactgtgcgagagatcgacatgaacgtaacgggaaatcttttagatctcggtggggaccaacgggacacgtcggtcaccgtctcttcacggtccctaccgaaccgaacggggccctacgttcccggttcccttcccccggtcggtcccgccccgttcgcccgtaccgacggacccg

SEQ ID NO: 386991 - DNA, 503 bp, Homo sapiens
  misc_feature: GZ8MTXP02F1M6W.22.86.H09.1.454.CMB.2.raw
  modified_base (327)..(327): a, c, t, g, unknown or other
  modified_base (352)..(352): a, c, t, g, unknown or other
tcagacatacgcgtcacgaccggtgctcgatttagtgctatagacttgggtttgggggaagaggaagactgacggtcctgccacaggtggtgctgggcacggtgggcactcgacacaacatttgcactcaactgtcttgtctcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtggctatggcatgcactggctccgccaggctccgggnaaggggctggagtgggtggcaattntatggtatgatggaagtaataaagactatgtggactcgtgaagggcgattcacatctccagagacaactcaagaacactctagtttacacctaaatgaaacagcctagagaggcgaggacacggcagtgtaattactgtgcgagacgatcg

SEQ ID NO: 386992 - DNA, 608 bp, Homo sapiens
  misc_feature: GZ8MTXP02GJJX3.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccgaggcctccgggacgaaggggctgggaggtgggtggactaaattatagtggtatgatggaaagtaaataaagactagtgtaggacctcgtaggaacggccgtattccacctatcctaccagacgacaactaccaaagaacacttctcgtttccaccaaatcgaaacacgaccgtggaaggacgggacggaacggacgacgggacagttagttaacttacgtggtaggaccggaagagactacgaactagtacgaacgtaaacggggaaagttctttagattccgtaggtcggggaccaagggacacgtggtccacgtctctccacgccctaccgaaccgtacggcccacgtccgtcccttccccgcggcctccctagccctcgacggaccg

SEQ ID NO: 386993 - DNA, 516 bp, Homo sapiens
  misc_feature: GZ8MTXP02FLJ5J.22.86.H09.1.454.CMB.2.raw
  modified_base (206)..(206): a, c, t, g, unknown or other
  modified_base (242)..(242): a, c, t, g, unknown or other
  modified_base (274)..(274): a, c, t, g, unknown or other
  modified_base (304)..(304): a, c, t, g, unknown or other
  modified_base (351)..(351): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtnatgttggtggttataactatgtctcctggtaccaangcaccaggcaaagccccagactcatcatttangctgtcaataagcgccctcgaggggtcccngatcgcttctctggctcaagtctggccaacacggcctccctcgaccntctctgggcctccaggctgaagatgagctgattatactgctgctcatttgcagcgcctacgacgttgggtgttcggcgggacggaccaagcgtcgaccgtcgaggtcacgacccgaacggcctccggccccaagtccggtcactccttcgtccccgccctacccg

SEQ ID NO: 386994 - DNA, 505 bp, Homo sapiens
  misc_feature: GZ8MTXP02FH0L4.22.86.H09.1.454.CMB.2.raw
  modified_base (401)..(401): a, c, t, g, unknown or other
  modified_base (435)..(435): a, c, t, g, unknown or other
  modified_base (443)..(443): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgccaggcctcccggggcaagggggctggggagtggggtggaccaattatatggtatgatggaaataaataaagctatgtgactcgtgaaggccgatcacatcncagagacactacaagacactctgttacacaaatnaacagccngagaggacgaggacacggacagtatacgttactgtgaacgagacgactcgacagtcgaacgg

SEQ ID NO: 386995 - DNA, 594 bp, Homo sapiens
  misc_feature: GZ8MTXP02I7PDJ.22.86.H09.1.454.CMB.2.raw
  modified_base (555)..(555): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcacatctccagagacaactccaaagaacactctcgttctaccaaatgaacagcctgagaggcgaggacacggcagtgtattactgtgcgagagatcgacatagaacgtaacgggaaagtcttttagattcgtcgtagggggacccaaaggggaccaacgttcgggtaccaacccggttctccgtttacacggtcccctacccgaacccgaaacggggccccctaaacgttcccgggtcccctttccccccgnggtccccgtccccgttcgcccgttacccgaacggacccg

SEQ ID NO: 386996 - DNA, 543 bp, Homo sapiens
  misc_feature: GZ8MTXP02GS3W1.22.86.H09.1.454.CMB.2.raw
  modified_base (342)..(342): a, c, t, g, unknown or other
  modified_base (379)..(379): a, c, t, g, unknown or other
  modified_base (387)..(387): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctgttcnccaaatcgaacagctggagaggcgagacacggcagtntattacgngtgcgagagatcgaacagtagacgtaacgggaaatctttgatcgtcgtgggaccaagggacacgtggtccaccgtcttactcacgtccctacgaccgaacgggcccacgttccggtcctcccccgtggtcccgccctcgacgtacccgaggacccg

SEQ ID NO: 386997 - DNA, 536 bp, Homo sapiens
  misc_feature: GZ8MTXP02JK2L8.22.86.H09.1.454.CMB.2.raw
  modified_base (362)..(362): a, c, t, g, unknown or other
  modified_base (519)..(519): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcacatctccagagacaactcaaagacactctcgtttcaccaaatcgaacagcctgagnggcgaggacacggcagtgtattactgtgcgagagatcgaacagtagactaacgggaaatcgttttagatcgtcgtaggggaccaaggggacacgtggtccacgtctcttcacgcctaccgacgaacgggcccacgttccggtccttccccgcggccnccctgcctccgagaccg

SEQ ID NO: 386998 - DNA, 516 bp, Homo sapiens
  misc_feature: GZ8MTXP02GKE3G.22.86.H09.1.454.CMB.2.raw
  modified_base (341)..(341): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctcccgccaggcctccggggcaaggggctgggagtggggtgcattanagtggtatgatggaaagtaataaagactagtgtggactcgtagaagggcgagttcaccatcctcaagagacactacaagaacactctgttcctaccaaatacgaacacgcctagacgaggacgaggacgacggcagtgtacgtacgtgtgcgagagactacgacatacgtaacgg

SEQ ID NO: 386999 - DNA, 518 bp, Homo sapiens
  misc_feature: GZ8MTXP02GSZQ2.22.86.H09.1.454.CMB.2.raw
  modified_base (231)..(231): a, c, t, g, unknown or other
  modified_base (369)..(369): a, c, t, g, unknown or other
  modified_base (407)..(407): a, c, t, g, unknown or other
tcagacatacgcgtcacgaccggtgctcgatttagtgctatagacttgggtttggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaangcacccaggcaaagccccagactcatcatttatgctgtcaataagcggccctcgaggggtccctgatcgcttctctggctccaagtctggcaaccacggccctccctgacccatctcgtgggctccaggcctgaaagntgaggctagattattacgtgctgctcatttcgcaggcncctactacgttggggtcgttcgggcggagggacctaagctacgaccgtctaggtcacgcccaaggcctcgcccctcggtccaactcgtccgttcccgcctcctcgacgtcg

SEQ ID NO: 387000 - DNA, 552 bp, Homo sapiens
  misc_feature: GZ8MTXP02JWVMD.22.86.H09.1.454.CMB.2.raw
  modified_base (352)..(352): a, c, t, g, unknown or other
  modified_base (382)..(382): a, c, t, g, unknown or other
  modified_base (527)..(527): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaagggccgattcaccatctccagagacaactcaaagacactctgttctcaaatgaacngctgagagcgagacacggcagtgtattacngtgcgagagatcgacagtgaacgtacgggaaaagtcgttttagattcgtcgtcgggggaccaaggggacacgtcggtccaccgtctccttcgacgcctcccaaccgtacgggccctacgtccggtccctttcccccgcgggcccnccccgtcggtcccaccgaacggccg

SEQ ID NO: 387001 - DNA, 556 bp, Homo sapiens
  misc_feature: GZ8MTXP02GEUKB.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggaggtgggtggcaattatatggtatgatggaaagtaataaagactatgtggactcgtgaaggccgattcacatctcagagacaactcaaagacactctgtttcaccaaatgaacagctgagaggcgagacacggcagtgtattactgtgcgagagatcgaacatacgaacgtaacgggaaagtcttttagactctcggtaggggacccgaaggggacacgtcggtccaccgtctcttcgacgccctacccaacccgaacgggccccacgtcccgtcccttcccccgtcggcccgtccccgtcgccgtcccgacggacccg

SEQ ID NO: 387002 - DNA, 638 bp, Homo sapiens
  misc_feature: GZ8MTXP02HU3KE.22.86.H09.1.454.CMB.2.raw
  modified_base (271)..(271): a, c, t, g, unknown or other
  modified_base (314)..(314): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttnagtggctatggcatgccacgtggcctcccgcaggcctccgggngaaggggctgggaggtggggtgcctaatttatagtaggtatggtaataggggaaagttaaataaaggacttaagtggtaggtaccgtaccggtaggaaacggggcccgtaattaccacccgtaatcctaccgaggaacgaacaaacctaccaaaacgaaactaccgttaccttagtttaccctaacctaaaacgtacgaaaccgtacgacccgtagggaaggaacggggacccggtaaggggaacccaacggggacctaaggttacgtaacgttaaccgtggtagaacggtaggaacgtacgtaccgatacgtacggtaaacgg

SEQ ID NO: 387003 - DNA, 584 bp, Homo sapiens
  misc_feature: GZ8MTXP02GABLH.22.86.H09.1.454.CMB.2.raw
  modified_base (429)..(429): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccattcaccatctccagagacaactccaaagaacactctcgtttctaccaaatcgaacagcctgagaggcgagacacggcagtgtattacgtgtgcgagagatacgacagtacgacgtaaacgggaaacgtnttttacgattcgtacggtcggggaccgaagggactacgtcggtaccgacccggttcttccgttacgacgtccctacccaaccggtaaccgggccctaacgtcccggttcccttcccccgttggcccgtccccgtcgtccctaccgacgggacccg

SEQ ID NO: 387004 - DNA, 607 bp, Homo sapiens
  misc_feature: GZ8MTXP02JOGT2.22.86.H09.1.454.CMB.2.raw
  modified_base (402)..(402): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaataaagactatgtggactccgtagaacggccgattcacatctcagacgacaactcaaagacactctcgttacacaaatcgaacagcctgacgaggcgagacgacgacagtgtattacgtgtgacgaganatacgaacagtacgaacgtaacgggtaaagttcgtttagacttcgtacgggtacggggaccgaaaggggacctacggttacgggtcctaacccggttcttacccgttaccgacggtacccctacccgaaacccggtaacggggcccctacgttccccggtcccttcccccgtggcccgtaccctcggccctaccggacggacccg

SEQ ID NO: 387005 - DNA, 598 bp, Homo sapiens
  misc_feature: GZ8MTXP02JQT6K.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggggcaaggggctgggagtgggtggcaattatagtggtatgatggaaagtaaataaagactagtgtggactccggtgaagggcctattcaccatctaccagagacaactaccaaagaacactcttcgtttccaccaaatcgaacagcctggagagggacgaggacacggctagtagtattacgtgtcgacgagagatacgaacagtagaacgtaaacggggaaatcgttttagattcgtacgggtacgggggaaccgaaggggtacctacggtcggtaccgtaccgtctccgttacgacgtccctaccgaaccgacggccctacgttcccggtacccttccccgtggcccgtcccgtgtccctaccgacgacccg

SEQ ID NO: 387006 - DNA, 578 bp, Homo sapiens
  misc_feature: GZ8MTXP02JL7VT.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtcctgacgactctcctgtgcagcgtctggattcaccttcagtggctagtggcatgcacgtggcctacccggccacgggccgtcccggggacgaagggggctggggaggtcggggtgacctaattagtgtggtatggatagggaaataaagtaaacgctagtgcgtactccgtagaacgggccgtattcaccatccacacgacaccaactaccaaagtaaccacttctagtttacctaccaaatacgaacacgtccaggacgacgggcggaacggacgacggaccgtaggtacgtagttacgtggtacgaaggagagactaccggaactacgtaggtaaaccgg

SEQ ID NO: 387007 - DNA, 541 bp, Homo sapiens
  misc_feature: GZ8MTXP02FLO61.22.86.H09.1.454.CMB.2.raw
  modified_base (391)..(391): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgtgaagggccgattcaccatctccagagacaactaccaaagaacactctcgtttctaccaaatgaacagctgagaggcgagacacggcagtgtattacngtgcgagagatcgacatgactaacgggaatctttagatctcggtaggggaccaagggacacgtggtacaccgtctcttcacgccctaccgaccgaacgggcccagtcccggttccctccccgtcggccgtccctcgcctccgacggaccg

SEQ ID NO: 387008 - DNA, 539 bp, Homo sapiens
  misc_feature: GZ8MTXP02IX36H.22.86.H09.1.454.CMB.2.raw
  modified_base (344)..(344): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaagggccgattcaccatctccagagacaactccaaagacactctgtttcnccaaatgaacagcctgagaggcgaggacacggcagtgtattactgtgcgagagatcgacatgactaacgggaaatctttagatctcgtaggggacccaaggggaccacgtggtccaccgtctctttcacgcctaccaccaacgggccctacgtccggtcccttccccgcggtcccgccctcgcctccgacggccg

SEQ ID NO: 387009 - DNA, 554 bp, Homo sapiens
  misc_feature: GZ8MTXP02GW6KY.22.86.H09.1.454.CMB.2.raw
  modified_base (336)..(336): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtggcctccgcgaggcctccggggnaaggggctgggagtggggtgactaattagtatgggtatggaatagggaaataaataaacgactagtggtaggactcggtaggaaagggaccgattaccaaccatcctacaagacgaacaactaccgaaagaactactacttgttacaccaaaatgaacacgcctagacggaggacgaggacacggacagtagtaactacgtgtagacgagagactacg

SEQ ID NO: 387010 - DNA, 646 bp, Homo sapiens
  misc_feature: GZ8MTXP02JJG0C.22.86.H09.1.454.CMB.2.raw
  modified_base (362)..(362): a, c, t, g, unknown or other
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagactctcctgtgcagcgtctggattcaccttcagtgctagtggcatcgcacgtggcctcccgcgaggccgtaccggggcgaaggggcctggggagtggggtgacctaagttatagtggtangaagtagggaaagttaaataaacggacttaagtcggtacgggtaacctcccgggtaggaaacgggtcccgtaactttaccaacccgtattcccgtacccaagggtaaaccgaaccaaacccgttaacccgaaacgtaaacctaccgtttacctttacgttttaccctaaaccctaaaagtacgaaactacgaccgtagaacgggacggacggaaacggacgacggactaacggtacgttattacgtgtacgaagaagagacgtacgaacacgtacgtaaaccgg

SEQ ID NO: 387011 - DNA, 594 bp, Homo sapiens
  misc_feature: GZ8MTXP02IY93S.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtggcctccgccaggccgtcccggggcgaaggggctgggaggtggggtggcctaagttatagtgggtatggaagtggggaaattaaataaaaggacttagtggtacggaccttccggtaggaacgggcccgtaattcccaacctatccctaccaagaacgaaccaaactacccaaagtaaccacttcttacgtttaccaaccaaaattcgaaacacgacctaggaacggacgacggaacggacaccgggctaagtacgtagttacgtgacgcgaagacgacgtaccgactagtacgtaaacgg

SEQ ID NO: 387012 - DNA, 571 bp, Homo sapiens
  misc_feature: GZ8MTXP02JKU5C.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggcaattatatggtatgatggaaagtaataaagactatgtgactcgtgaaggccgatcaccatctcagagacaactccaaagaacactcttcgtttacctaccaaaatcgaacacgcctgagaggcgaggacacggcagtagtaattacgtgtagcgaagagatacgaacagtagaacgtaaacggggaaattctttagattcgtcggtaggggaccaaagggcctagtcggcctaccgtctacttcgacgccctaccgaaccgaacgggccctacgtccggttccctccccggtcggcccgtccctcgcctacccgaggtacccg

SEQ ID NO: 387013 - DNA, 558 bp, Homo sapiens
  misc_feature: GZ8MTXP02HX7YW.22.86.H09.1.454.CMB.2.raw
  modified_base (321)..(321): a, c, t, g, unknown or other
  modified_base (383)..(383): a, c, t, g, unknown or other
  modified_base (390)..(390): a, c, t, g, unknown or other
  modified_base (538)..(538): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaaataaagactatgtggactccggtgaacggccgattcaccatctccaganacaactacaaagaacactctcgttctaccaaatgaacagctgagaggcgagacacggcagtntattacngtgcgagagatcgacagtgaacgtaacgggaaagttctttagattcgtacggtaggggacgaaaggggctaacgtggtaccaccgttcgtcttcacgtccctaccaaccgaacgggccctacgtcccgtcccttcccccgtcggcccncccctgccctcgacggaccg

SEQ ID NO: 387014 - DNA, 582 bp, Homo sapiens
  misc_feature: GZ8MTXP02JHKXS.22.86.H09.1.454.CMB.2.raw
  modified_base (335)..(335): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtctggattcaccttcagtggctatggcatgcactggcctcccgccaggcctccggggnaaggggctggggagtggggtgactaagttatagtgggtatggaatagggaaagttaaagtaaaagactaagttggtaggtaccgtccggtaggaaacggggcccgatttccgaaccatacctccaagacgaaccaaacctaccaaacgaactacctcgttacgtttacctacctaaatcgaaacacgcctagagaggacgaaggacgacggacagtagtaagttacgtgtcggacgtagacgatacg

SEQ ID NO: 387015 - DNA, 540 bp, Homo sapiens
  misc_feature: GZ8MTXP02H8G5E.22.86.H09.1.454.CMB.2.raw
  modified_base (514)..(514): a, c, t, g, unknown or other
  modified_base (519)..(519): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaaagtaataaagactatgtggactccgtgaaggccgattcaccatctccagagacaactccaaagaacactctgtttcaccaaatgaacagcctgagaggcgagacacggcagtgtatactgtgacgagagatcgactagtagacgtaaacgggaaagttcttttagattcgtcgtcggggaccaaggggacacgtcgtcaccgtctcttcagtccctacaccgaacggcccacgtccgtccttccccgnggccncccgtcgcctccgacggaccg

SEQ ID NO: 387016 - DNA, 557 bp, Homo sapiens
  misc_feature: GZ8MTXP02FZ9JQ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctagtggcatgcacgtggcctcccgccaggcctccgaggcgaaggggctgggaggtggggtcggacaattatagtggtaatggagtgggaaagtaaagtaaagacttagtggtggaacgtccggtaggaaacgggccgagttccaaccatcctaccgagaacgaaccaaactaccaaagaacctacttcttagtttaccaacctaaatacgaaacagcctagagaggacgacggacacgggatacggtgtactacgtgcgacgagacgatacgacagtacgg

SEQ ID NO: 387017 - DNA, 586 bp, Homo sapiens
  misc_feature: GZ8MTXP02IIVI6.22.86.H09.1.454.CMB.2.raw
  modified_base (374)..(374): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtagaaggccgattcaccatctccagagacaactccaaagaacactctcgtttcaccaaatgaacagcctgagaggcgagacncggcagtgtatactgtgcgagagatcgaacagtagaacgtaacgggaaaattcgttttagaattccgtacgtacgggggaccaaaaggggacacgtacggtaccacccggttctcctttcgacgtccctaccgaacccgtaaacggggcccctaacgttcccggtccctttaacccccgtggcccgtcccctgacccttaccgacggacccg

SEQ ID NO: 387018 - DNA, 531 bp, Homo sapiens
  misc_feature: GZ8MTXP02I38M2.22.86.H09.1.454.CMB.2.raw
  modified_base (434)..(434): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctagtggcatgcacgtggcctcccgccagggcctcccggggcaaggggctgggaggtggggtgctaattatagtggtatggatggggaaataagtaaaagacgtagtggtagggactccggtagaacgggccattcacatctcagagacactacaaanaacactctcgttactaccaaatgaacagacctgagaggacgacggacgacggcagtagttactacgtgtacgaagagagatcgacagtacggtaacg

SEQ ID NO: 387019 - DNA, 573 bp, Homo sapiens
  misc_feature: GZ8MTXP02HIFRT.22.86.H09.1.454.CMB.2.raw
  modified_base (396)..(396): a, c, t, g, unknown or other
  modified_base (552)..(552): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaaagtaaataaagactatgtaggactccggtaggaagggccgattcaccatctccagacgacaactccaaagaacactctcgtttacctaccaaatcgaacagacctggagacggacgaggacacggcagtntattactgtagacgagagatacgacatacgaacgtaacgggaaatcgtttagatcgtcggtacggggacgaagggaccacgtcggtaccaccgtctacttcgacgtccctaccgaaccgaacgggccctacgtcccggtacccttccccgcggccncccgtcgccctaccgagaccg

SEQ ID NO: 387020 - DNA, 708 bp, Homo sapiens
  misc_feature: GZ8MTXP02HXLR6.22.86.H09.1.454.CMB.2.raw
  modified_base (253)..(253): a, c, t, g, unknown or other
  modified_base (271)..(271): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtgctatggcatgcactggctccgcaggctccgggcaaggggctggagtgggtgcaattatanggtatgataggaataaanaaagactatgtggactccggtagaacgggccgtattccacaatcctacaagacgacaaactaccaaaagaaccacgtctcgtttacacctaaaatcgaacagtcctgagaggaccgagacacggcaagtagtaataacgtgtacggacgaagaagactacgaaactaagttgaaaacgtaaacggggtaaaagttccgttttaggaattaccgtcgggtacgggggaccgaaaacgggggacctacgttacgggtaccctaacccggttacctaccgtttccgaaaccggttccccctaaccccgaaacccggaaacccgggggtacccccctaacggtttcccccgggttacccccgttttccccccccgggtcggggaccccccggttacccccgttcgggtacccccctacccggtaaaacccggggaccccgg

SEQ ID NO: 387021 - DNA, 662 bp, Homo sapiens
  misc_feature: GZ8MTXP02H4UTC.22.86.H09.1.454.CMB.2.raw
  modified_base (263)..(263): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcggtggtccagccgtgggacggtcctgacgactctcctgtgcagcgtntggattccaccttcaggtggctagtcggcagtgccacgtcggccctccggccgacggccgtcccgggacgaaggggctaggggaggtggggtggacctaaagttagtagtagggtataggaagtggggaaaagttaaagtaaaacgacgttaagtgggtacggtaacccgttaccgggtaggaaacggggtcccgtaacttacccaacccgtaattcccgaccgaaaggaaccgaacctaaacctaccgaaaacgtaaacctaacctttcgttacgtttaccaaccctaaaagtcgaaacgtacgaccgtaggaaggacgggacggaacggacgacggactaaggttgttaactacgtggtacgaacggagaagacgtacggactagtacggtaaccgg

SEQ ID NO: 387022 - DNA, 535 bp, Homo sapiens
  misc_feature: GZ8MTXP02I62CE.22.86.H09.1.454.CMB.2.raw
  modified_base (314)..(314): a, c, t, g, unknown or other
  modified_base (340)..(340): a, c, t, g, unknown or other
  modified_base (401)..(401): a, c, t, g, unknown or other
  modified_base (406)..(406): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggcctccgccaggcctcccggggnaggggctgggagtggggtgctaattntatggtatgatgggaaataataaagctatggtaggactccgtgaacggcgattcacatccncaganacactaccaagaaccacttcttacgtttactacccaaaatcgaaacaggacctaggaacgagggcgaacgggacacgggcaaggtgtaacttacgtgtggcgagaacgatcggaactagacgtaaacgg

SEQ ID NO: 387023 - DNA, 594 bp, Homo sapiens
  misc_feature: GZ8MTXP02HG22Z.22.86.H09.1.454.CMB.2.raw
  modified_base (242)..(242): a, c, t, g, unknown or other
  modified_base (360)..(360): a, c, t, g, unknown or other
  modified_base (387)..(387): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacngcacccaggcaaacgcccccagactcatcatttatgctgtacaataagccggccctcgacggggtccctgactcgcttctctggcctccaagtctcggcaacgcggcctccctgaccntctcgtcgggcctccgaggctagaagntgaggctgattatactgctgtctctagtttcgcgtacggccgtacctacgtacgtttggggtcggttcgggacgggacgggaccgaacgtcgtcggtaaccgtccgtacgggtaccacggaccccgaacgggtccctacccggccccccgttcgggtaccctaccgttcccgttacccggtttccccctaccccttcccgttacccg

SEQ ID NO: 387024 - DNA, 578 bp, Homo sapiens
  misc_feature: GZ8MTXP02GDGPH.22.86.H09.1.454.CMB.2.raw
  modified_base (333)..(333): a, c, t, g, unknown or other
  modified_base (394)..(394): a, c, t, g, unknown or other
  modified_base (434)..(434): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctaagctgggttttcctcgttgctcttttaagaggtgtccagtgtcaggtgcagctgggtggagtcgtggggggagcgtggtccagcctgggagtccctgagactctcctgtgcagcgtctggattcaccttcagtggctatggcatgcactggctccgcaggcctccggggnaaggggctggggacgtggggtgactaatttgtagttgggtatggaattacgggaaattaanaaaaggctaatggtagactccgtaggaaggccgtatcacntcacgagagacaactcaaagaactactctagtttaccactaaacgtacgaactacgccctaggacggaaacgggacggaacgggaaccgacgggaccgtaacggtaggttattaacgttgaggacgaggagacgtaccgaaacg

SEQ ID NO: 387025 - DNA, 527 bp, Homo sapiens
  misc_feature: GZ8MTXP02J11FD.22.86.H09.1.454.CMB.2.raw
  modified_base (344)..(344): a, c, t, g, unknown or other
  modified_base (404)..(404): a, c, t, g, unknown or other
  modified_base (419)..(419): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgtgaaggccgattcaccatctccagagacaactccaaagaacactctgttcnccaaatgaacagcctgagaggcgaggacacggcagtgtattactgtgcgagagatcgaanatagacgtaggaatnttagatctcgtgggacgaaggacacgtcgtcacgtctctcacgccctaccaccgaacggcccacgtccggtcccttccccgtcggcccgcccgtcgcctccgacggcg

SEQ ID NO: 387026 - DNA, 644 bp, Homo sapiens
  misc_feature: GZ8MTXP02G7BW4.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaaataaagactatgtggactccgtgaaggccgattcacatctccagagacaactccaaagaacactctcgtttcaccaaatgaacagcctgagaggacgaggacacggcagtgtattacgtgtgacgagagagtacgacgatacgaaccgtaaaggggaaaagttctttttagagttccgtcggttaggggacccgaaaggggacctacgtcgggtccctaaccggttccgttctttaccgacggtcccccttaacccgaaccccgaaaaccgggggtccccctaaacggtttccccggggttacccctttcccccccggttcgggcccccggtccccttccgggaccccttacccggaacgggtaaaccccgg

SEQ ID NO: 387027 - DNA, 645 bp, Homo sapiens
  misc_feature: GZ8MTXP02GGIBR.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgcacgtggcctcccgccaggccgtccggggcgaaggggctgggaggtggggtggacctaaattagtagtgggtatggaagtaggggaaataaataaaaggtacttagtagggtacggaccttaccggtaggtaaacggggcccgtaattcccaacctactcctaccgaagacgaaccaaactacccaaaagaaacctaccttacgttacgttttaccctaaccaaaacgttacgaaaccgtacggaccgtaggaaaggacgggaccggaaacgggaaccgaacggggacctaagggttagttacgtttaccgtggttagaacggtaaggaagtacgtacgaacagttaccgtaaacgg

SEQ ID NO: 387028 - DNA, 605 bp, Homo sapiens
  misc_feature: GZ8MTXP02FUEAS.22.86.H09.1.454.CMB.2.raw
  modified_base (250)..(250): a, c, t, g, unknown or other
  modified_base (281)..(281): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctcgggcaaggggctggagtgggtgcaattanatggtatgataggaaataataaagactatgnggactcgtggaacggcgatcacatctaccagacgacaactaccaaagacactcttacgtttaccacctaaatcgaacagcctgacgaggcgagacacggcagtcgtattactgtacgagagagatacgaactagtacgaacgttaaacgggaaagttcttttagacttacgttacgggtacggggaaccgaaagggtacctacggttcggtaccctaccggttcttacgttaccacgtccctacccgaacccgaacgggaccctacgttcccgggttcccttcccccgtcggcccgtccccgtgtacccgtaccgacggaaccg

SEQ ID NO: 387029 - DNA, 588 bp, Homo sapiens
  misc_feature: GZ8MTXP02H7B3S.22.86.H09.1.454.CMB.2.raw
  modified_base (337)..(337): a, c, t, g, unknown or other
tcagacatacgcgtcacgaccggtgctcgatttagtgctatagacttgagctctgggagaggagccccagcactagaagtcggcggtgtttccattcggtgatcagcactgaacacagaggactcaccatggagtttgggctgagctgggtttttcctcgttgctctttttaagaggtgtccagtgtcaggtgcagctggtggagtcgtgggggaggcgtggtccagccgtgggaggtccctgagactctcctgtgcagcgtctggattcaccttcagtggctatggcatgcactggctccgcaggctccgggcaaggggctggagtgggtgcaatntatggtatgatgggaagtaataaagctatgtgactcgtgaggcgatcacatctaccagacgacaactaccaaagaactaccgtctacgtttactacctaaaacttgaaactacgacccgttaggaacggaacgggccggaaacgggacgaacccggggaccgtaaacggttagtttaacgttaaaccgttgggttaggtaaccggaaggaaaggtacgttaccgggaacctaacgtacggtaaaacccggg

SEQ ID NO: 387030 - DNA, 497 bp, Homo sapiens
  misc_feature: GZ8MTXP02FMCGD.22.86.H09.1.454.CMB.2.raw
  modified_base (309)..(309): a, c, t, g, unknown or other
  modified_base (340)..(340): a, c, t, g, unknown or other
  modified_base (396)..(396): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggnaaggggctggagtgggtgcattatatggtangatgggaaataataaagactatgtggactcgtgaaggccgattcaccatctcaganacactacaaagacactctagttactacaaatgaacacgctagagaggcgaggacacggcagtcgtattacgtgtgaacgagacgactcgacagtagtaacg

SEQ ID NO: 387031 - DNA, 638 bp, Homo sapiens
  misc_feature: GZ8MTXP02JS0LV.22.86.H09.1.454.CMB.2.raw
tcagacatacgcgtcacgaccggtgctcgatttagtgctatagacttgagctctgggagaggagcccagcactagaagtcggcggtgtttccattcggtgatcagcatgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgccgaggccgtccggggcgaaggggctggggaggtggggtggaccgaagttatagtgggtatggaatgggaaaagtccctaaaaagtctaagtggttacgggtactacccgggtaggaaacggggtcccgtaacgtttaccaaccctactacctaccgaacggaacgaaccaaaacctacccaaacgaaaccaactacttacgtttaccttaaccgtcccctaataaaccgacgtacgacggacggaacgggacggaacggaccggacggaaccgtagtacgttacgtaacgttcgtacggtaacggaagtcggaacgtacgacgacgtacggaaaaacgg

SEQ ID NO: 387032 - DNA, 625 bp, Homo sapiens
  misc_feature: GZ8MTXP02FLZ1M.22.86.H09.1.454.CMB.2.raw
  modified_base (377)..(377): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtgactcgtgaaggccgatcacatctccagagacaactccaaagaacactctcgtttcaccaaatgaacagctgagaggcaggacacggcagtntattactgtgcgagagatacgaactatacgaacgtaacggggaaagttcttttaggaacttcgttacggtagggggaccccaaaagggggaccctaacgttcgggtacccaacccggttcttaccgttaccgaaccggtccccttaacccgaaacccggaaaacggggtccccctaaacgttccccggggttaccccttccccccgttgggccccgtccccgttcggccctacccgacggggaacccg

SEQ ID NO: 387033 - DNA, 715 bp, Homo sapiens
  misc_feature: GZ8MTXP02IQTC7.22.86.H09.1.454.CMB.2.raw
  modified_base (290)..(290): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctcgggcaggggctggagtgggtggcaattatatggtatgatggaaagtaataaagactatgtggactccgngaaggccgattcaccatctaccagagacaactaccaaagaacactctacgtttacctaccaaatcgaacacgccctggagaggacggagacgacggcagtgtattacgtgtgacgagagacgtacgacgtaagtaggaaccggtaaacggggtaaaacgttcgtttttacggaacgtttcccgttacggggttacgggggtaacccgtaaaacgggggaaccgtaccgggttaccggttacccggttaaaccccgggttccctttacccggttttacccaaccggttcccccgtaaccccggaaaacccccggtaacgggggtaccccctaaacggtttcccccgggtttccccgttaacccccccggtcggggtacccccgtacccccgttacggcccccgttacccggaccggggtaaccccg

SEQ ID NO: 387034 - DNA, 595 bp, Homo sapiens
  misc_feature: GZ8MTXP02GXQLK.22.86.H09.1.454.CMB.2.raw
  modified_base (321)..(321): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctcctgtgcagcgtctggacttcaccttcgagtggctagtggcagtgcacgtggcctccgcgaggctcccggggngaggggctggggaggtggggtgacctaagttatagtggtatgagtgggaaataaataaagacttagtggtaggaccgtcgaggaacggggcctacttcgaccctagtcctaccgaagacgaaccaacctaccaaagaaacctacttcgttactttacctaaccctaaaatacgaaaccgagtacccgtaggaacggacgggacggaacggaccgacgggctaaggtacgttacttacgtgtagaacgagagacgtacgacagtacggtaaacgg

SEQ ID NO: 387035 - DNA, 848 bp, Homo sapiens
  misc_feature: GZ8MTXP02IL3T2.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagctctcctgtgcagcgtctggattcaccttcagtggctatggcatgcacgtcggcctcccgcccgacgggcccgtcccggggacgaaagggggccttaggggacggtgggggtcggacccgtaaagttttagtaagttggggttaataggtaagttagggggtaaaagttaaaacgtaaaaaggtactttaaagtggggtacggtaacccgttacccggggtaagggaaacggggtacccggtaacgtttacccgaaacccgtaaacttcccggttaaccccaaacgggaaaccggaaaacccgtaaaacccgttaaacccccgaaaaacggtaaaacccccgttaaaccgttttaccctttaaccgggttttttaaaccccctaaaacccgttaaaaaacgtttaccgggtaaaaaccctaaaccggaccccgttaaggggaaacggggtaaaacggggacccggggtaaaacggggaaacccgaaaccgggggaacccgttaaaggggtttacgtttaaagttttaaacccggttgggttacggaacccggtaaaggaaacgggttaactaacgggaacctaacggtttacgggtaaaaacccggg

SEQ ID NO: 387036 - DNA, 573 bp, Homo sapiens
  misc_feature: GZ8MTXP02IF5MC.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcagtggctagtggcatgcacgtggcctcccgcaggccgtcccggggcgaaggggctggggagtggggtgactaagttatagtggtatgatagggaaataaataaagtactagtggtagaccgtccgtaggaacgggccagttccaacctatcctcaagagaaccaactaccaaagaacctacttcttacgtttacctaacccaaatacgaaacacgtaccgtagaacggaggacgaacggacgacgggactaggtacgttattacgtgtagaacggagagactacgactagtacgtaaacgg

SEQ ID NO: 387037 - DNA, 588 bp, Homo sapiens
  misc_feature: GZ8MTXP02HCGVA.22.86.H09.1.454.CMB.2.raw
  modified_base (241)..(241): a, c, t, g, unknown or other
  modified_base (337)..(337): a, c, t, g, unknown or other
  modified_base (350)..(350): a, c, t, g, unknown or other
  modified_base (397)..(397): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctgtaccaacngcacccaggcaaacgcccccagactcatctattatgctgtacaataacgccggccctcgacggggtccctgatcgcttctctgctcagtctgcacncgcctcctgaccntctcgtcgggcctccgaggctgaaagtatggagtctgatttattacngtctgactctatttgacacggtccgtacccttacgtaccgtttgggggtcgttcggggaccgggaacggggaccgtaaaggtccgtcggtaacccggtacccgttacggtaccgacgacccgaacggtccgtcccgcccccgttccgtaccgtacccttccgttccgttaccccctacccgtccctacccg

SEQ ID NO: 387038 - DNA, 569 bp, Homo sapiens
  misc_feature: GZ8MTXP02JRGHA.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtggcaattatagtggtatgatggaaagtaaataaagactatgtggactccgtagaagggccgattcaccatctccagagacaactaccaaagaacactctcgtttccaccaaatcaacacgcctggagacggacgagacgacggcaggtagtattacgtgtgacgagagatacgacagtcgaacgtaacgggaaagttctttagattcgtcggtagggaccgaagggacacgtcgtcacccgtctcttcacgccctaccgaaccgacggtcccacgttccggtcccttccccgtcggccctcccgtcgccctaccgacggaccg

SEQ ID NO: 387039 - DNA, 693 bp, Homo sapiens
  misc_feature: GZ8MTXP02GU4GK.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgagactctcctgtgcagcgtctggattcaccttcagtggctatggcatgctactggcctcccggccgaggccgtcccggggcaagggggcctggggaggtggggtaggaccctaaattagtagtggtatgaagtaggggaaaattaaagtaaagacttagtgggtcggaactaccggtaggaaacgggccgtaacttccaacccgtactccgtaccaaggaaacgtaaccaaaccgttaccaaaacgtaaacctaccttacgttacgttttacctaaccctaaaagttacggaaaccgacgtacccgttagggaaacggtaacgggggaccggaaacggggaaccggaaccggggtaccgtaaagggttacggtttaaaccgttaacggttggttacgggaaccggtaagaacggtaacgttaccggaactaaggtaaccggttaaaaccgggg

SEQ ID NO: 387040 - DNA, 548 bp, Homo sapiens
  misc_feature: GZ8MTXP02F9EVD.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaagaacactctcgtttctccaaatgaacagcctgagaggcgagacacggcagtgtattactgtgcgagagatcgacatagactagggaaagtctttagatcgtacgttgggggaccctaaaggggacacgtggtaccaccgtctcttcgacgccctacccaaccgaacgggccccagtcccggtaccttcccccgtggccgccccttgccctccgacggaccg

SEQ ID NO: 387041 - DNA, 506 bp, Homo sapiens
  misc_feature: GZ8MTXP02F3XSM.22.86.H09.1.454.CMB.2.raw
  modified_base (314)..(314): a, c, t, g, unknown or other
  modified_base (342)..(342): a, c, t, g, unknown or other
  modified_base (407)..(407): a, c, t, g, unknown or other
  modified_base (484)..(484): a, c, t, g, unknown or other
  modified_base (487)..(487): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcgtctggattcaccttcagtggctatggcatgcactggctcccgccaggctcccggggnaaggggctgggagtgggtggcctaattnagtggtatgatgggaaataataaagactagtgtggactcgtagaaggccgattcacatctcaganacactacaaagacactctgtttcaccaaatgaaacagacctagagacggacgaaggtacgacggcagtatacttacngtngagagactcgacatgaacg

SEQ ID NO: 387042 - DNA, 530 bp, Homo sapiens
  misc_feature: GZ8MTXP02IXZ09.22.86.H09.1.454.CMB.2.raw
  modified_base (283)..(283): a, c, t, g, unknown or other
  modified_base (341)..(341): a, c, t, g, unknown or other
  modified_base (384)..(384): a, c, t, g, unknown or other
  modified_base (444)..(444): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtggcaattatatggtatgatggaagtaataaagactatgnggactccgtgaaggccgattcaccatctccagagacaactccaaagacactctgttcnccaaatgaacagcctgagaggcgagacacggcagtgtattacngtgcgagagatcgacatgaactaacgggaaatctttagatctgtacgggccgaagggacnctgggtcaccgtctcttcacgcctaccgaccgaacgggcccacgtccggtccttccccgtggccgtccctgcctccgacggacccg

SEQ ID NO: 387043 - DNA, 683 bp, Homo sapiens
  misc_feature: GZ8MTXP02GX0W6.22.86.H09.1.454.CMB.2.raw
  modified_base (312)..(312): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggcctccgcaggcctcccggggngaaggggctgggaggtggggtgacctaattatagtggtatggaatggggtaaataaataaaaggacttaagtgggtagggaaccgttacccggtagggaaaacgggggtcccgtaatttacccgaaccctaacttcccgtacccgaaaggaaacggaaacctaaaaccttaaccccaaaacgtaaacctacctttacctttacggtttttaccaaaccctaaaaattaccggaaaacctaacggcccgttaggaaaggacggggaccggaaaacgggaccgaacgggacctagggttacgttaacgtttaaccgtgggttagaaccggaaggaacgaagttaccgaaaccgtaggttacggtaaaaccggg

SEQ ID NO: 387044 - DNA, 593 bp, Homo sapiens
  misc_feature: GZ8MTXP02J3H0L.22.86.H09.1.454.CMB.2.raw
  modified_base (188)..(188): a, c, t, g, unknown or other
  modified_base (330)..(330): a, c, t, g, unknown or other
  modified_base (335)..(335): a, c, t, g, unknown or other
  modified_base (349)..(349): a, c, t, g, unknown or other
  modified_base (369)..(369): a, c, t, g, unknown or other
  modified_base (570)..(570): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcacgtggctccgccaggccgtccgggacgaaggggctgggagtggggtgactaattatagtggtatgatagggaaataaataagactagtgtacggactccggtaggaacgggcctattccacatcncaganacaactcaaagacntctcgttacacaaatcaacngctggacgacggcgtagaccacggactagtacgttaacttacgtgggtacgacggaagacggataccggaataacgtaggtaaccgtaaacgggggtaaattcgttttacggattcgtacgggtacgggacaacggggtacacgtggtccaccgtctctcgacgtccaccaacgtacgcctacgtcccgtccgttccccgnggcccgcctgcctaccgagcccg

SEQ ID NO: 387045 - DNA, 531 bp, Homo sapiens
  misc_feature: GZ8MTXP02GFXNN.22.86.H09.1.454.CMB.2.raw
  modified_base (506)..(506): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgccaggctccggggcaaggggctgggagtggggtggacctaaattatatgggtatggatgggaaagtaaataaaggactatggtggactccgtggaaacggccgattcaccatctcaagagacaactaccaaagaacactctgtttacctaccaaatacgaacacgcctagaggaggacgaagggtacacgggcaagtcgtatacgtggngaagagagacacgacagtacgaacg

SEQ ID NO: 387046 - DNA, 555 bp, Homo sapiens
  misc_feature: GZ8MTXP02GN7TD.22.86.H09.1.454.CMB.2.raw
  modified_base (252)..(252): a, c, t, g, unknown or other
  modified_base (480)..(480): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattnatggtatgatggaaagtaataaagatatgtgactcgtgaaggccatcacatctccaagagacaactccaaagaacactctcgtttacaccaaatgaacagcctgagaggcgagacacggcagtagtattacgtgtgcgtaagagatcgacatagaacgtaacggggaaatcgttttagattcgtcgtggggaccaaggggaccagtcggtccaccgtctccttcgacncccgtacccaaccggaacggccctacgtcccggtaccttcccccgtcgcccgtacccctgcctaccgaggacccg

SEQ ID NO: 387047 - DNA, 535 bp, Homo sapiens
  misc_feature: GZ8MTXP02IAWK3.22.86.H09.1.454.CMB.2.raw
  modified_base (265)..(265): a, c, t, g, unknown or other
  modified_base (503)..(503): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagccgtggggacggtccctgacgactctcctgtgcagcgtcnggacttcaccttcagtggctatggcatgcactggcctcccgcaggctccggggcgaaggggctgggaggtgggtggcaagttatagtggtatggagtggaaagttaaacaaaagtctaatggtagactccgtaggacggcgattcacatctacagacacaactaccaagaacacttctagtttacacctaaatagaacagcctagagagacgacgacgacggcaggtctagtacgtgngaacgagagtataccggactagtacgaaacgg

SEQ ID NO: 387048 - DNA, 618 bp, Homo sapiens
  misc_feature: GZ8MTXP02I036C.22.86.H09.1.454.CMB.2.raw
  modified_base (239)..(239): a, c, t, g, unknown or other
  modified_base (272)..(272): a, c, t, g, unknown or other
  modified_base (363)..(363): a, c, t, g, unknown or other
  modified_base (389)..(389): a, c, t, g, unknown or other
  modified_base (409)..(409): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaangcaccaggcaaacgccccagactcatcatttangctgtacaatacgcgccctcgacggggtccctgactcgctttctctcggtcctccgaagtctcggaccaaccgccggccctcctgaccctntcctcgtggcctccgagctagaaagntggagctagtattagttacngtcttgcttcgtagtttcgacgacggtcctacccgttacgtacggtttggggttcggttccggggacggggtaacggaccgaacggtccgtaccggtacccgttccggtaacggtccgaaccggacccgtaaaccgggtccgtccccggtcccccgtcgggttaccctaccgttcccgttacccgttccccctacccctcccgtacccg

SEQ ID NO: 387049 - DNA, 684 bp, Homo sapiens
  misc_feature: GZ8MTXP02IGFIH.22.86.H09.1.454.CMB.2.raw
  modified_base (260)..(260): a, c, t, g, unknown or other
  modified_base (270)..(270): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcggtggtccagccgtgggagtccctgacgactctctgtgcagcgtntggtacttcnccttcgagtggctagtgcatcgctacgtcggcctcccggcgacgggccgtcccggggacggaaggggcgttggggagggtggggtacgacgttaaagtttataggtaggtagttaggaagttagggggtaaaattaaaacgtaaaacggtactttaggtacgggtacgtaaccgttaccgggtagggaaccggggtaccgtactttaccaacccgtattacccgtacgaagaaccgaaaccaactaaccgaaaacaaacctactttcgttactttaccaaaccaaagttacaaacacgtccgaggaacggagggacgaacgggtacgaccgggataaacggttacgttacgttacgttggacgtaacggaacggaacgtaccgtaaccggactagttaacggtaaaacccgggg

SEQ ID NO: 387050 - DNA, 642 bp, Homo sapiens
  misc_feature: GZ8MTXP02GS71V.22.86.H09.1.454.CMB.2.raw
  modified_base (449)..(449): a, c, t, g, unknown or other
  modified_base (615)..(615): a, c, t, g, unknown or other
  modified_base (621)..(621): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggccgtccggggacgaagggggctgggaggtggggtggactaaattagtagttggtatgagtaggaaagtaaataaagactagtggtggactccggtaggaacgggccgtattccaacctactcctaccgaagaacgaaccaaacctaccaaaagaactacttcttacgtttaccaccaaaatcgaaacacgctgaggaggacggagacacggctaagtgttaattacgnggtacgacgaagacgtacgtacgaactagtagtaaccggtaaacggggtaaattcgttttagacgttcgtacgggacggggaacccaaaggggcctacgtcggacctaccgtctactcgaccgtccctaccgaacgaaccggccctacgtcccggtccctccccgngccccnccgtcgcctaccggagtaccg

SEQ ID NO: 387051 - DNA, 588 bp, Homo sapiens
  misc_feature: GZ8MTXP02JXG3N.22.86.H09.1.454.CMB.2.raw
  modified_base (411)..(411): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcacgtggctccgcaggcctccgggcgaaggggctgggagtgggtgactaattatagtggtatggataggaaataataaagactagtgtacggactccggtaggaacgggcctattccacctatcctaccaagacgaaccaactaccaaaagaaccacttctacgtttcaaccaaatgaacagcctagaggaggtcgaggacacggganaggtgtattacgtgtcgagagagatacgacagttacgaacgtaaacggggaaattcgtttagatcgtcgggtacggggaccgaaaggggtacacggtcgtacctacgtctcttacacgtccacccgacgacggcccacgttccggtcccttcccgcggcctccctgcctcgacgccg

SEQ ID NO: 387052 - DNA, 544 bp, Homo sapiens
  misc_feature: GZ8MTXP02INF89.22.86.H09.1.454.CMB.2.raw
  modified_base (429)..(429): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggtttttcctcgttgcttcttttaagaggtgtccagtgtcaggtgcagctggtggagtcgtgggggagcgtggtccagccgtgggagtccctgagactctcctgtgcagcgttctggattcaccttcagtggctatggcatgcacgtggcctccgccaggcctccgaggcgaagggcgtggaggtggggtggacaagtttatagtggtatgagtaggaaagtaaataaagcttaagtgtagactcgtagacggcattcgacatcacagagacaactccaaanactactcttagttaccacaagtcacagaccgtagaggacggcgaacggacacggacaggttcgttaaacgtttacgtggtaaggacgtagaacgacgttacgaactagtaaacgg

SEQ ID NO: 387053 - DNA, 565 bp, Homo sapiens
  misc_feature: GZ8MTXP02IOV6H.22.86.H09.1.454.CMB.2.raw
  modified_base (345)..(345): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgtgaaggccgattcaccatctccagagacaactccaaagaacactctgtttcnccaaatgaacagcctgagaggcgagacaggcagtgtattactgtgcgagagatcgacatgactaacgggaaagtctttgattctgtcggggaccaagggacacgtggtcaccggtctccttcgacgtccctaccaaccgaaacgggtcccctaacgttcccggttcccttcccccggtcgggtcccgtcccccgttcgacccgttcccgaacggtacccg

SEQ ID NO: 387054 - DNA, 560 bp, Homo sapiens
  misc_feature: GZ8MTXP02JSZ7J.22.86.H09.1.454.CMB.2.raw
  modified_base (380)..(380): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgacaattatatggtatgatggaagtaataaagactatgtggactccgtgaagggccgattcaccatctccagagacaactccaaagaacactctctttcaccaaatgaacagcctgagaggcgagacacggcagtntattactgtgcgagagatcgaacatgaacgtaacggggaaagtcttttaggatcgtacgtcggggacccaaggggaccacgtcggtctacccgtctaccttcgacgccctaccgaaccgtaaacgggccccagttccggtcccttcccccgtggcccgtccctgccctccgacggacccg

SEQ ID NO: 387055 - DNA, 604 bp, Homo sapiens
  misc_feature: GZ8MTXP02GD0CK.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggagcgtggtccagccgtgggacggtccctgagactctcctgtgcagcgtctggattcaccttcagtggctatggcagtgcactggctcccgccaggcctccggggcgaaggggctgggaggtggggtaggactaaagttagtagttggtatgtaagttagggaaagttaaaagtaaaagtactaagtggtacggtacgtccggtaggaaacggggtccgatttaccgaacctatccgtaccaaggaacaaccaactaccgaaagaacctaacttccttagtttcctaaccaaaatcgaaacgacgtaccaggaagacgggcgaaacgacgacggacagttagtaacttacgcgtagacggtagaagtacgacg

SEQ ID NO: 387056 - DNA, 566 bp, Homo sapiens
  misc_feature: GZ8MTXP02GWM6B.22.86.H09.1.454.CMB.2.raw
  modified_base (327)..(327): a, c, t, g, unknown or other
  modified_base (334)..(334): a, c, t, g, unknown or other
  modified_base (455)..(455): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctggggagtccctgagctctcctgtgcagcgtctggattcaccttcagtggctatggcatgcactggctccgcaggctcgggnaggggcngggagtgggtgcaagttatagtggtatgagtaggaaagtaaagtaaacgatatagtaggtacgtccggtaggaacgggaccgtagttacaccatactaccaagacgaacaactaccgaaanaaacctactacttacgttacttaccaaaactacgaaacagacccgtaggacgacgggacgaacgggaacgacggacgagtagtaattaacgtgtacgagacgacgagtacg

SEQ ID NO: 387057 - DNA, 588 bp, Homo sapiens
  misc_feature: GZ8MTXP02GZGMW.22.86.H09.1.454.CMB.2.raw
  modified_base (294)..(294): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgacaattatatggtatgatggaaagtaaataaagactatgtggactcgngaaggcgatcacatctcagagacaactccaaagaacactctcgtttctaccaaaatcgaaacagcctgagaggcgagacacggcagtagtattactgtgcgaagagatcgacagtagaacttaacggggaaatcttttagatcgtcggtggggacccgaaaggggcctaacgtcgggtacctaccgtcttccttaccgacgtcccctacccgaaccgaaaccggggcccctaacgttccggtaccccttcccccggtcggccccgtaccccgtcggccctacccgaacggaccg

SEQ ID NO: 387058 - DNA, 619 bp, Homo sapiens
  misc_feature: GZ8MTXP02ICN0H.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggacttcaccttcagtggctatggcatgcactcggcctcccgccgacgggccgtcccggggacgaagggggctggggacggttggggtggacctaaagttatagtagggtatggaagtagggaaaagttaaataaaggtacttaagtggtagacctccgggtaggaacgggcccgtaattccgaaacctattcctacccaagaaccgaaacaaacctaccaaaacgtaaccaactttcttacgtttaccaaccctaaaattcgaaaacacgcctaggacgaacggccggaaggaccgacgggactaggtacgttactacgtgtacggaagagaagtacgtacgaacagttacgaacgg

SEQ ID NO: 387059 - DNA, 628 bp, Homo sapiens
  misc_feature: GZ8MTXP02JD332.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggctccgggnaaggggctgggagtgggtgctaattatatggtatgataggaaagtaataaagactagtgtggactccggtaggaacgggccgtaatttccaacctattctaccgaagacgaccaaactccaaagaaccacttctacgtttcaccaaatgaacagcctgagacggacgagacgacggcagtatattacgtgtgacgagagacgtacgaacagtacgaacgttaaacggggaaattcgttttagaacttcgtacgggtacgggaaccgaaaggggactaaccggtcggtacctaaccgttctcctttaccgacgtcccctaacccgaaccgaaacgggtcccctaacgtccccggttcccttccccgcggtcccgtcccgttcgacccgtaccggacggaccg

SEQ ID NO: 387060 - DNA, 596 bp, Homo sapiens
  misc_feature: GZ8MTXP02HB0IF.22.86.H09.1.454.CMB.2.raw
  modified_base (259)..(259): a, c, t, g, unknown or other
  modified_base (566)..(566): a, c, t, g, unknown or other
  modified_base (575)..(575): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagctctcctgtgcagcgtcnggattcaccttcagtgctatggcatgcacgtggcctccgccaggccgtcccggggcaaggggctggggaggtggggtagacctaaatttagtagttaggtatgaaagttggggaaaattaaaataaaaggacttagtaggtagggaacctccgtaggaaacggggccgtattaccaccctaatcctaccgaaggaacaaccaaacctaaccgaaaacgtaaacaacttacttacgtttacctaaccctaaaagtacgaaacacggtaccctagaagaggacgaggacccgaggcaaggtctattacngtcgaaganacgataccgaacagtagaacg

SEQ ID NO: 387061 - DNA, 560 bp, Homo sapiens
  misc_feature: GZ8MTXP02J1925.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggagtgggtggcaattatatggtatgatggaagtaaataaagactatgtggactccgtgaaggccgattcacatctccagagacaactaccaaagaacactctcgtttacctaccaaatgaacagcctgagaggcgaggacacggcagtgtatactgtgcgagagatcgacatcgaacgtaacgggaaattcttttagacttcgtcggtaggggaccaaggggactacgtaggtcctaccgtctcttcgacgtcccacccgaaccgaacgggccctacgttcccggtcccttccccgtggccctaccctcgcctaccgacgaccg

SEQ ID NO: 387062 - DNA, 598 bp, Homo sapiens
  misc_feature: GZ8MTXP02G31J7.22.86.H09.1.454.CMB.2.raw
  modified_base (206)..(206): a, c, t, g, unknown or other
  modified_base (216)..(216): a, c, t, g, unknown or other
  modified_base (230)..(230): a, c, t, g, unknown or other
  modified_base (262)..(262): a, c, t, g, unknown or other
  modified_base (375)..(375): a, c, t, g, unknown or other
  modified_base (391)..(391): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctgcactgggaccagcagtgatgttggncttataactntgtctctggtaccngcaccaccagcaacgccccaatcttaatttgntacataccgccctgacgggtcctgatcgcttcgtccgctccaagtctggctaacaccggtcctcctgaccccatctcgtagactccagctgacgatggaggtgtacttttacncgctgctacattacgngccgaaggtacaaacttaattaaattgtcggttacgttcgggacgggaacggaaccgtaaaagtccgtacccgtacgttacggaccgacgtaccccgaaggcccttcccggtaccccgtcggtacctaccgttcccgttcccgttacccccaaccctttcccaacgtaacccgtacggttactcgtcccgttaggacggtcccgggg

SEQ ID NO: 387063 - DNA, 511 bp, Homo sapiens
  misc_feature: GZ8MTXP02H05H8.22.86.H09.1.454.CMB.2.raw
  modified_base (359)..(359): a, c, t, g, unknown or other
  modified_base (487)..(487): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgatgttggtggttataactatgtctcctggtaccaacagcaccccaggcaaaagcccccagactcatcattatgctgtcaataagcggccctcaaggggtccctgatcgcttctctggctccaaagtctggcaaacacggcctccctgacccntctctgggctcccaggctgaagatgagctgattattactgctgctcaatttgcaggcgccctacacttgggtgttcgggcggaggggaccaaagctcgaccgtcctaggtcagcccaaggctgccccncggtcactctgttcccacctcctc

SEQ ID NO: 387064 - DNA, 660 bp, Homo sapiens
  misc_feature: GZ8MTXP02F0WT0.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgcactggcctcccgccgagggccgtcccggggacgaacggggggtcctaggggtagggtggggtacgtaccgttaaagtttagtaggttagggtataggtaaggtaggggtaaaagttaaaagtaaacgtattagtagggtacggtaccgtacggtagggacggacgtacgttaccactactcctacgaagaacgaaacctaacctaaccgaaactaacctaccttactttacgtttacctaaacctaaagtaccgaaacgtaccgtaccgtagggaacggacgggacggaacgggaccgaccggacgtaacgtagttaaccgttgtaggtacggaacgaggacgtacgacgacgtagtacggtaaaccgggg

SEQ ID NO: 387065 - DNA, 665 bp, Homo sapiens
  misc_feature: GZ8MTXP02J1N24.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctgggtgtgggtggctaattatatggtatgataggaaagtaaataaagactatggtggactccggtagaacgggccgattcaccatccacagagacaactccaaagacactctagttccaccaaatcgaacagctgagacggacgagacacggactagtattattacgtgtcgacgaagagactacggaactagtacgaacgtaaaccggggtaaagttcgttttaggaacgtttcctaccggggttacgggggaaccccgaaaacgggggtacctaacgggtttcggtaccccgtaaccccgggttacttcccgtttaccgaaccggtcccccttaccccgaaaccggtaaacccggggtcccctaacggttccccggttcccctcccccggtcggggtccccctcccgtccgcccgtaccggacggtcc

SEQ ID NO: 387066 - DNA, 525 bp, Homo sapiens
  misc_feature: GZ8MTXP02HUK4N.22.86.H09.1.454.CMB.2.raw
  modified_base (211)..(211): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttanaactatgtctctggtaccaacagcacccagtcaaagcccccagactcatcattatgctgtcaataagcggccctcgagggtccctgatcgcttctctggctcaagtctggcaaccacggcctccctgaccatctctgggctccaggctagaagatgaggctgacttattactgctgctcatttgcaggcgctacacttggggtgttcggcggaggtaccaagcgtgtaccgtctacgggtcaggcccaaagggtcctcgcccccgttcggcctaacgtccctcgtttcccccgcccttccctcgtaccggtccg

SEQ ID NO: 387067 - DNA, 523 bp, Homo sapiens
  misc_feature: GZ8MTXP02HF6Q6.22.86.H09.1.454.CMB.2.raw
  modified_base (373)..(373): a, c, t, g, unknown or other
  modified_base (382)..(382): a, c, t, g, unknown or other
  modified_base (490)..(490): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccggggcaaggggctgggagtggggtgaccaattatatggtatgatgggaaagtaaataaagactatgnggactccgngaaggcgattcacatctcagagacaactaccaaagaacacttctgtttactaccaaaattcgaaacacgcctaggagaggacggaggacacgggctagtcgtattacngtagaacgagagacgtacgacagtacgaaacgg

SEQ ID NO: 387068 - DNA, 554 bp, Homo sapiens
  misc_feature: GZ8MTXP02GSNPL.22.86.H09.1.454.CMB.2.raw
  modified_base (384)..(384): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtggcaattatatggtatgatggaaagtaataaagactatgtgactcgtgaaggcgatcacatctcagagacaactccaaagaacactctcgtttccaccaaatcgaacagcctgagaggacgagacacggcagtgtattacngtgcgagagatacgacatagacgtaaaggggaattcgttttagaattctcggtaggggaccaaggggacacgtcggctaccgtctcgttacacgcctacccgaacgaacgggtccctacgtcccggttcccttcccccggtcggcccgtcccgtcgcctaccgaggaccc

SEQ ID NO: 387069 - DNA, 555 bp, Homo sapiens
  misc_feature: GZ8MTXP02JR9G3.22.86.H09.1.454.CMB.2.raw
  modified_base (350)..(350): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtggactccgtgaaggccgatcaccatctccagagacaactcaaagacactctcgtttcaccaaatnaacagctgagaggcgagacacggcagtgtattactgtgcgagagatcgacatgaacgtaacgggaaattcgtttagattcgtcggtacggggaccaaggggactacgtcggtacctaccgtctcttcgacgtccctacccgaccgaacgggccctacgtcccggttccctccccgtcgcccgtccctcgcctaccgaggtacccg

SEQ ID NO: 387070 - DNA, 596 bp, Homo sapiens
  misc_feature: GZ8MTXP02G2GWI.22.86.H09.1.454.CMB.2.raw
  modified_base (266)..(266): a, c, t, g, unknown or other
  modified_base (303)..(303): a, c, t, g, unknown or other
  modified_base (418)..(418): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgcccctgactcagcctcgctcagtgtccgggtctcctggacagtcagtcacatctcctacactggaaccagcagtgatgttggtgttatactatgtctcctgtaccaanacgcacccaggcaaacgcccccagactcatcatttangctgtacaaataacgccggccctcgacggggtccccctgactcgtcttctctggctcaagtctgccaacgcgccctccctgaccctatctcgtgggcctccgaggtctagaaagngtgaggtctgtaattatactgtctgtctctatttcgcgtacggccgtacccttaacgtcggtttcggggtacggttccggggaacgggtaccgggggtaacccgaaggtcccggttacggtaacccccggttacccggttaaacggtccccgtaaccgggtacccccgtaaaccgggg

SEQ ID NO: 387071 - DNA, 565 bp, Homo sapiens
  misc_feature: GZ8MTXP02F6TFW.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaagtaataaagactatgtggactccgtgaaggcgattcacatctcagagacaactcaaagaacactctgtttctaccaaatcgaacagcctgagaggcgagacacggcagtgtattactgtgcgagagatcgacatagacgtaacgggaaagtcttttagatcgtacgtggggaccaaaggggacacgttcggtcaccgtctcttacacgtcctaccgaaccgaaacgggcccctaacgtccgggttcccttccccccgtcgggtccccgccccgttcgacccgttccgacgggtaacccg

SEQ ID NO: 387072 - DNA, 550 bp, Homo sapiens
  misc_feature: GZ8MTXP02JW0GF.22.86.H09.1.454.CMB.2.raw
  modified_base (454)..(454): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcacgtggcctccgccaggccgtccggggcgaaggggctggggagtggggtgacctaattagtatggtatggatggggaaagtaaataaagactagtggtaggacctccggtaggaaacggggccgattccaaccatcctaccgaagacgacaactaccaagaacnctctagtttacaccaaatcgaacacgcctaggacgaggcgaaggaccagggcagtgtactacgtgtgaacgagacgatacggactagtagaaacgg

SEQ ID NO: 387073 - DNA, 610 bp, Homo sapiens
  misc_feature: GZ8MTXP02F7DNL.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggacgtccctgagactctcctgtgcagcgtctggattcaccttcagtggctagtggcatgcacgtcggcctcccgcaggccgtcccgggcgaaggggctggggagtggggtgacctaattatagtggtatgagtggggaaataaagtaaagacttagtggtaggactacggtaggaacggtccgagttacaacctactcctacaagacgaacaacctaaccaaagaacctacttacttacgtttaccaaccaaaacttacgaaaccacgtccgtaggaacggacgggacggaacgggaaccgacggtacgtaaggttagttacgtttaaccgtggtacgaacggtaagaacggtacgtacgaactagtacgtaaaccgg

SEQ ID NO: 387074 - DNA, 560 bp, Homo sapiens
  misc_feature: GZ8MTXP02HS22T.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtggcaattatatggtatgatggaagtaataaagactatgtggactcgtgaagggccgattcaccatctccagagacaactccaaagaacactctcgtttctaccaaatgaacagcctgagaggcgacggacacggcagtgttattactgtcgcgagagatcgacatagaactagggaaatcttttaggatcgtcgtacggggaccaaggggacacgtggaccaccgtctcttcacgtccctccaaccgaacgggccccaagtccccggtccttcccccgtagggcccctcccgcgtcccgtaccgacggtacccg

SEQ ID NO: 387075 - DNA, 524 bp, Homo sapiens
  misc_feature: GZ8MTXP02FY79G.22.86.H09.1.454.CMB.2.raw
  modified_base (389)..(389): a, c, t, g, unknown or other
  modified_base (402)..(402): a, c, t, g, unknown or other
  modified_base (421)..(421): a, c, t, g, unknown or other
  modified_base (491)..(491): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggaggtccctgagactctcctgtgcagcgtctggatcacttcagtgctatggcatgcacgtggcctcccgccgaggccgtcccgggcgaaggggctggggagtggggtggactaattatagtggtatgatgggaaataaataaagactagtgtgactcgngaaggcatcacanctcagagacactaccaaanacactctgttacctacaaatgaacagcctagagacgggcgaacggacaccgggcaggttcgtagttacgnggtgaacgagagacgtcgaacagtagtaaaccg

SEQ ID NO: 387076 - DNA, 541 bp, Homo sapiens
  misc_feature: GZ8MTXP02HMVL3.22.86.H09.1.454.CMB.2.raw
  modified_base (332)..(332): a, c, t, g, unknown or other
  modified_base (342)..(342): a, c, t, g, unknown or other
  modified_base (350)..(350): a, c, t, g, unknown or other
  modified_base (363)..(363): a, c, t, g, unknown or other
  modified_base (368)..(368): a, c, t, g, unknown or other
  modified_base (373)..(373): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtgctatggcatgcactggctccgccaggcctccgggcaaggggctgggaggtggggngacctaattnagtggtangatgggaaataanaaagntatgngactcgtagacggcatcacctatcctacagacgacaactaccaaagaacactttctagtttccaacctaaatacgaacagtcctagaaggaggaccgaagggaccaacgggtcaaggttacgtattaccgtggtacgcggaagaggtacacgacagttacggaaacgg

SEQ ID NO: 387077 - DNA, 557 bp, Homo sapiens
  misc_feature: GZ8MTXP02INEHF.22.86.H09.1.454.CMB.2.raw
  modified_base (227)..(227): a, c, t, g, unknown or other
  modified_base (252)..(252): a, c, t, g, unknown or other
  modified_base (340)..(340): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattntatggtatgatggaagtaataagactatgtgactccgtgaaggcgattcaccatctccagagacaactccaagaacactctcgtttcnccaaatgaacagcctgacgaggcgagacgacggcagtgtattacgtgtgcgagtagatcgacagtagactaacgggaaatcttttagacttctcggtcggggacccgaagggacacgtcggtcaccgtctcgttacacgccctaccgaccgaacgggcccctaagtcccgttcccttcccccgttcggcccgtccctcggccttccgacggtacccg

SEQ ID NO: 387078 - DNA, 575 bp, Homo sapiens
  misc_feature: GZ8MTXP02G5FSX.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggagcgtggtccagcctgggagtccctgagctctcctgtgcagcgtctggattcaccttcagtggctatggcatgcactggcctccgccaggcctccggggcgaaggggctggggaggtggggtgactaattagtagtgggtatggagtaggaaagtaataaagactagtgtaggactccggtaggaacgggccgtagttccaacctatcctaccgagacgaaccaacctaccaaagaacctacttcgttacgtttaccacctaaatacgaaacacgcctaggacggaggacggaaggaccgaccggacgtagtagtaagttacgtggtacgacgagacgatacg

SEQ ID NO: 387079 - DNA, 627 bp, Homo sapiens
  misc_feature: GZ8MTXP02ION3C.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcacgtggcctcccgcaggcctccggggcgaaggggctgggaggtggggtggacctaagttatagtggtatggaatggggaaataaataaaagacttagtggtacgggactaccggtgaaacggggccagttccaaccctatcctaccgaagacgaaccaacctaccaaaagaaacctaaccgttcttacgttttacctaaccctaaaattcggaaaactacggacccgttaggacggaacggggacggaacgggaaccgaaccgggacgtaaaggttaggttaacgtttaacgtggtaggaaccggtaagacgtacgtacgactaacgtacggtaaaaccgg

SEQ ID NO: 387080 - DNA, 520 bp, Homo sapiens
  misc_feature: GZ8MTXP02F1UAZ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggagtccctgagctctcctgtgcagcgtctggattcaccttcagtggctagtggcatgcactggctccgcaggctccgggcaaggggctgggagtggggtggacctaattatatggtatggaatggaaataaataaagctatgtggactccgtagaaggccgattcactatctacgagagaacactaccaaagaacactcttcgtttacaaccaaatacgaacacgacctgacgaggcgaacggaccacggcagtcgtactacgtgtagcgagagactcgacacgtagaacgg

SEQ ID NO: 387081 - DNA, 691 bp, Homo sapiens
  misc_feature: GZ8MTXP02FXEO5.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtgctatggcatgcacgtggcctccgccgaggccgtcccggggacaagggggtctaggggacggtggggtggacctaaagtttagtagttggttaatggaagttaggggaaaagttaaataaaaggtacttagttagggtcgggaaccgttccggtaggaaacggggtacccgtaactttaccgaaccctagtccctacccgaaggaacgaaccaaaccgttacccgaaagaaaccctaccttaccgttacgttttaccctaaccgtaaaacgttagaaaccaggtacccgtaggaacgggacgggacggaaacgggaaccgacgggacgtaaaggttagttaacgtttaacgtggttacggaaccgggtaaggaacggtaacgtacccggaacgtaacggtacggttaaaaccggg

SEQ ID NO: 387082 - DNA, 588 bp, Homo sapiens
  misc_feature: GZ8MTXP02FIMSV.22.86.H09.1.454.CMB.2.raw
  modified_base (239)..(239): a, c, t, g, unknown or other
  modified_base (273)..(273): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaanagcaccaggcaaacgccccagactcatcatttangctgtacaataagcggccctcgacggggtccctgatcgcttctcgtggctacaagtctcggacaaccgacggccctcctgacctatcctcgtcggggcctccgaggctagaaagagtggaggtctagtatttatactgctgctctatttcgcgacggcctcctaacgtacgttgggtcgttcgggacgggaacgggaccgaagtcgtacggaccgtaccgtacgggtaccacggaccccgaacgggtccctcccggtccccccgtaacggtccctaaccgttcccttcccgtttcccccaccccgttcctacccg

SEQ ID NO: 387083 - DNA, 521 bp, Homo sapiens
  misc_feature: GZ8MTXP02I6OBK.22.86.H09.1.454.CMB.2.raw
  modified_base (240)..(240): a, c, t, g, unknown or other
  modified_base (273)..(273): a, c, t, g, unknown or other
  modified_base (350)..(350): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccanagcacccaggcaaagccccagactcatcattangctgtcaataagcggccctcgaggggtccctgatcgcttctctggctccaagtctggcaacacggcctccctgaccntctcgtcgggcctccgaggctgaagatgaggctgattattactgctgctcatttgcaggcgccctacgtacgttcggggtgttcgggcggtacgggaccaagctcgaccgtctaggtcacgcccaaggcctcgcccccgtggtcaccgtctccgttcccacccgtcctccg

SEQ ID NO: 387084 - DNA, 519 bp, Homo sapiens
  misc_feature: GZ8MTXP02GV653.22.86.H09.1.454.CMB.2.raw
  modified_base (344)..(344): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaaagaacactctgtttcnccaaaatgaacagcctgagaggcgagacacgggcagtgtattactgtgcgagagatcgaacatagactaacgggaaagtctttagatctcgtggggaccaaggggacactggtcaccgtctcttcagcctcacaacggcccatccggtctccccgtggccgccctgctcgagacg

SEQ ID NO: 387085 - DNA, 516 bp, Homo sapiens
  misc_feature: GZ8MTXP02F3X8L.22.86.H09.1.454.CMB.2.raw
  modified_base (330)..(330): a, c, t, g, unknown or other
  modified_base (355)..(355): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctcccgcaggctccgggnaaggggctggagtggggtgcaattntatgggtatgatgaaagtaaataaagactatgtgactcgtagaaggcgattcacatctcagagacaacgtaccaagaacactactgttactaccaaatgaactagcctagacgaggcgaggacacggacagtagtaagttacgcgtagacgagacgatacg

SEQ ID NO: 387086 - DNA, 571 bp, Homo sapiens
  misc_feature: GZ8MTXP02FMF4A.22.86.H09.1.454.CMB.2.raw
  modified_base (341)..(341): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtggctatggcatgcactggctccgccaggctccggggcaagggggctgggagtggggtgcctaattanagtggtatgagtggaaagtaataaagctagtgtggactccgtagaaggccgtattccgacatctaccagacgaacaactaccaaagaaacacttctagtttactaccaaatgaaacacgaccgtaggaagacgggacggtaacgggaccgacggggacctaggttagttaacgtttaaccgtggtggaacggtaaggaagacgttacggaacagttacgtaaaacccggg

SEQ ID NO: 387087 - DNA, 586 bp, Homo sapiens
  misc_feature: GZ8MTXP02H8DMC.22.86.H09.1.454.CMB.2.raw
  modified_base (261)..(261): a, c, t, g, unknown or other
  modified_base (374)..(374): a, c, t, g, unknown or other
  modified_base (473)..(473): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttctcgttgctcttttaagaggtgtccagtgtcaggtgcagctggtggagtcgtgggggaggcgtggtccagccgtgggacggtccctgagactctcctgtgcagcgtnggattccaccttcagtggctagtggctatggcacgtggcctacccgccgagggtcctcccggggacgaagggggctggggacggtggggtaggcctaaagttatagtgggtanggaattggggaaattaaacgtaaaagtactatgggtagacctcccggtaggaaggtcccgtattccgaacctattccacagacgacaaactaccgaaanaaccacttctacgtttaccaaccaaagtcgaaactgaccgtaggagacgggtcgaaggacgtaccggcgtagtgtaactcgtggtgcgagacgataccggactagtacgacgg

SEQ ID NO: 387088 - DNA, 550 bp, Homo sapiens
  misc_feature: GZ8MTXP02I43IY.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaagtaataaagactatgtggactccgtgaaggccgattcaccatctccagagacaactccaaagaacactctcgttctaccaaatcgaacagcctgagaggcgaggacacgggcagtgtattacgtgtgcgagagatcgacatagactaacggggaaagtcttttagattcgtcgtggggaccaaggggacacgtggtcaccgtctcttcacgtccctaccaccgtaacgggcccacgttccggtaccttcccccgtggcccgtcccgtggcctccgacggtaccg

SEQ ID NO: 387089 - DNA, 571 bp, Homo sapiens
  misc_feature: GZ8MTXP02G7GTT.22.86.H09.1.454.CMB.2.raw
  modified_base (240)..(240): a, c, t, g, unknown or other
  modified_base (273)..(273): a, c, t, g, unknown or other
  modified_base (357)..(357): a, c, t, g, unknown or other
  modified_base (385)..(385): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaangcaccaggcaaacgccccagactcatctattangctgtacaataagccggccctcgacggggtccctgactcgcttctctcggctccaagtctcggcaaccacggcctccctgaccntcctcgtcgggcctccaggctaggaagngtagaggtctgtaattattactgactgctctatttcgcacgggccacctacgacgttgggtcgttcgggcggacggaccgaagtcgtacggaccgttcgtacggtccacgacccgtaacgggcctaccggcccccgtaacggtcctaccgttccgttccgttcccccggtcccctcccgttacccg

SEQ ID NO: 387090 - DNA, 527 bp, Homo sapiens
  misc_feature: GZ8MTXP02FISW8.22.86.H09.1.454.CMB.2.raw
  modified_base (341)..(341): a, c, t, g, unknown or other
  modified_base (497)..(497): a, c, t, g, unknown or other
  modified_base (512)..(512): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgcaggctccggggcaaggggctgggagtggggtggccaattanatggtatgatgggaaagtaaataaagactatgtggactccgtgaagggcgattcaccatccccagacgacaaactaccaaagaacactctgtttacctaccaaatacgaaacagccgtagagagggacgaggacgacggcacgtgtattacgtggngagaagagacacganagtacgacgtaacgg

SEQ ID NO: 387091 - DNA, 588 bp, Homo sapiens
  misc_feature: GZ8MTXP02F904R.22.86.H09.1.454.CMB.2.raw
  modified_base (309)..(309): a, c, t, g, unknown or other
  modified_base (325)..(325): a, c, t, g, unknown or other
  modified_base (545)..(545): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcatggtccagcctgggaggtccctgagactctcctgtgcagcgtctggattcaccttcagtgctatggcatgcactggctccgcaggctccgggnaagggctggagtgggngcaattatagtggtatgagtaggaagtataaagactaagtggtacggaaccgtcggtagggaacggcgtactacactactcctaccgagacgaacctaacctaaccgaaacgaaactaccttacgtttacgtttacccaaactaaacgtacaaacgacgacgtaggaacggacgggacgaaacggacgacggtacgaggttacgtacgtacgtggtacgnggaagaagagtaccggaacacgtacggtaacggtaacggtacg

SEQ ID NO: 387092 - DNA, 608 bp, Homo sapiens
  misc_feature: GZ8MTXP02IJCDY.22.86.H09.1.454.CMB.2.raw
  modified_base (228)..(228): a, c, t, g, unknown or other
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcgtccgggnaaggggctggaggtgggtggcaattatatggtatgatggaaataataaagactatgtgactcgtgaaggcgattcaccatctccagacgacaactaccaaagaaccactctcgtttactccaaaatgaacagcctgagaggcgagacacggcagtgtatactgtcgnggagagatacgacagtagacgtaaacggggaaattcttttaggacttcgttcggtacgggggacccaaaagggggctaacgttcgggtcctaaccgttcctactttaccgacgtcccccttacgaaacccgaaacgggggtccccctaaacgtttcccgggtcccctttccccggcggtcccgtccccgttaggcccttaccgacgggacccg

SEQ ID NO: 387093 - DNA, 554 bp, Homo sapiens
  misc_feature: GZ8MTXP02GQBKT.22.86.H09.1.454.CMB.2.raw
  modified_base (297)..(297): a, c, t, g, unknown or other
  modified_base (416)..(416): a, c, t, g, unknown or other
  modified_base (436)..(436): a, c, t, g, unknown or other
tcagacatacgcgtcacgaccggtgctcgatttagtgctatagacttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctacactggaaccagcagtgatggttgtgtataactatgtctctggtaccaacagcacccaggcaaagcccccagactcatcattangctgtcaataagcgcctcgacggggtccccctgactcgctttctcttggccttccaagtcctggccaacaccgcctaccctgacccatctctgggcctccgagctagaagatgagctanattagttactgcctgccttntacgttgcgacgccgtaccttacgtacggtttcgggtacggttccggggacgggtaacggaaccgaacggtccgtaccggtacccggttacgtacggtaccgaccggacccgtaacgg

SEQ ID NO: 387094 - DNA, 560 bp, Homo sapiens
  misc_feature: GZ8MTXP02GJBHS.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtggactccgtgaagggccgattcaccatctccagagacaactccaaagaacactctcgtttcaccaaatgaacagcctgagaggcgagacacggcagtgtattactgtgacgagagatcgacatagacgtaaacggggaaatcttttagattcgtcggtacgggacccgtaaggggactacgtggtccaccgtctcttaccacgtccctaccaaccgaacgggtcccacgtccgttccctcccccgtggcccgtccctgcccgtaccgaggacccg

SEQ ID NO: 387095 - DNA, 557 bp, Homo sapiens
  misc_feature: GZ8MTXP02GWGL1.22.86.H09.1.454.CMB.2.raw
  modified_base (241)..(241): a, c, t, g, unknown or other
  modified_base (361)..(361): a, c, t, g, unknown or other
  modified_base (407)..(407): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaacgcccccagactcatcatttatgctgtacaataagcggcccctcgaggggtccctgatcgcttctctggcctccaagtctcggaccaaccacggcctccctgaccntctcgtggcctcaggctgaagatgagctagattattactgctgctntatttgctaggctcctacgacgtttcggggtggtttccgggcgggtacggggaccaaggtccgtagtacccggttcgtaacggtcacggacccaacggggtcctcgccccccgtcggtccactccttccgttcccccacccgtcctaccg

SEQ ID NO: 387096 - DNA, 518 bp, Homo sapiens
  misc_feature: GZ8MTXP02GGAWG.22.86.H09.1.454.CMB.2.raw
  modified_base (336)..(336): a, c, t, g, unknown or other
  modified_base (355)..(355): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccggggcaaggggctggagtggggtgcaattnatggtatgatggaaataanaaagactatgtaggactcgtgaaggccgaattcaccatctccagacgacaactccaaagaaccactctgtttacaccaaatcgaaacagacctagagacggcgaacggacaacgggcaaggttacgtagttactgtacgaagagaagatcgacagtagaaacg

SEQ ID NO: 387097 - DNA, 568 bp, Homo sapiens
  misc_feature: GZ8MTXP02G53UM.22.86.H09.1.454.CMB.2.raw
  modified_base (548)..(548): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcctccgggcaaggggctgggaggtgggtggcaattatatggtatgatggaaagtaataaagactatgtggactccgtgaacgggccgatcaccatctcagacacaactccaaagacactctcgttctaccaaatgaactagcctggagaggacgaggacacggctaggtgttattacgtgtaggcgagagactacgaacagtacgaacgttaaacgggaaagttctttgatcgtcggtacggggaccaaggggactacgtcggtaccaccgtctcctacacgtcccacccgacgacggcccacgtcccggttcctcccccgtggcccnccctgcctaccgacggaccg

SEQ ID NO: 387098 - DNA, 566 bp, Homo sapiens
  misc_feature: GZ8MTXP02HFH8V.22.86.H09.1.454.CMB.2.raw
  modified_base (330)..(330): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggatcaccttcagtggctatggcatgcactggctccgccaggcgtccgggnaaggggctaggggaggtggggtggctaattagatggggtatgagtagggaaagtaaataaagactatggtacggactccggtaggaacgggcgtaacttcgaaccactctacccgagagaaccaactaccaaagaacctactcgtacgtttactaccaaatacgaaacgagaccctagaggaggacgaggaactacggacgagtgtaagttacgtagtggacaggaagtacgtacg

SEQ ID NO: 387099 - DNA, 709 bp, Homo sapiens
  misc_feature: GZ8MTXP02II0ZA.22.86.H09.1.454.CMB.2.raw
  modified_base (261)..(261): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggaggtccctgagctctcctgtgcagcgtcnggattcaccttcagtggctagtggcatgcctacgtggctcccgccaggccgtccggggcgaaggggctgggaggtggggtggacctaaagtttatagtagggttatggtaagtagggtaaaaggttaaaataaaacggtacttaagttggtacggtaaccgtacccgggttaggaaaccgggggtcccgtaactttccaaacccctacttaccgtacccgaaagaaccgaaaccctaaaccgtaaaccccaaaggaaaaccctaacttttccgttacgtttttaacccctaaccgaaaaacttacggaaaacctacggtacccgtaggaaaccgggagggacccgggaaagggttaccgaccggggacctaaagggttacgtaactttaaccggtggtaacggaacgtaaaggaacgtacgtacgaacgtaacggttacggaaaccgg

SEQ ID NO: 387100 - DNA, 582 bp, Homo sapiens
  misc_feature: GZ8MTXP02GNR7Z.22.86.H09.1.454.CMB.2.raw
  modified_base (311)..(311): a, c, t, g, unknown or other
  modified_base (316)..(316): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactatgtggactccgtgaaggcgatcacatcncaganacaactacaaagaacactctcgtttactaccaaatcgaacagcctgagaggcgagacacggcagtgtattacgtgtagacgaagagatacgaacatagaacgtaacggggaaattcgttttagatcgtacggtaggggacccaaggggacctacggtcggtaccaccgttcgtcttacgacgtccctaccgaaccgaaccgggccctaacgtcccggttacccttcccccgtcggcccgtccccgtgcccgtacccgaaggacccg

SEQ ID NO: 387101 - DNA, 675 bp, Homo sapiens
  misc_feature: GZ8MTXP02GXEEY.22.86.H09.1.454.CMB.2.raw
  modified_base (419)..(419): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgccaggcctccgggcaaggggctgggaggtgggtggactaattatagtggtatgataggaaagtaaataaagactatgtggactccggtgaacggccgatcaccatctcagacacaactaccaaagaacacttctcgtttaccaactaaatcgaacacgactggacggaggacggaggaccgacggactagttagttattacgnggtacggacgaagtagacgtcgaaactagtaggaaccgttaacggggaaatttcgttttagaacgttcggttacgggtacgggggaacccgtaaaggggtaccctacgggttaccgtaccgtaacccgtttcgttcccgttaccgaccgtccccgtaccccggaaaccggaacccggggtacccctacggttccccggttaccccttcccccggtcggccccgtccccggttacgcccgtaccgggacggtacccg

SEQ ID NO: 387102 - DNA, 566 bp, Homo sapiens
  misc_feature: GZ8MTXP02GFKRZ.22.86.H09.1.454.CMB.2.raw
  modified_base (352)..(352): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaaataaagactaatgtggactccgtgaaggccgattcaccatctccagagacaactccaaagaacactctgtttcaccaaatnaaacagcctgagaggcgagacacggcagtgtattacgtgtgcgagagatcgacatgacgtaacgggaaatcgttttagatacgtcgtaggggccgaaagggacacgtcggtcaacccgtctctttcgacgtccctaccgaaccgaaacgggcccctaacgtcccggtacccttcccccgtcggcccgtccccgtcgaccgtccgacgggacccg

SEQ ID NO: 387103 - DNA, 662 bp, Homo sapiens
  misc_feature: GZ8MTXP02HZ0TK.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgagactctcctgtgcagcgtctggtacttcaccttcagtgctagtggcatgcacgtcggcctcccggccaggcctaccgagggaccgaaggggcgttaggggagggttggggtacggactaaagtttatagttggtaacgttagagttacgggaaaattaaagtaaagtaacgttagtagggtacggtaccgtaccggtaggaaacggggtcccgtatttacccgaactacgtacctaccgaagacaaaccgtaaacctaccgaaaagtaacctacttacggtttactttacccaaacctaaagtacgtaaaccgacggtacccgtaagacgggaacgggaccgaacgggaaccgaccgggacgtaaggttcgttaaacgttcgtaggcgtacgaaggtacgacgttcggaatacggtaacgg

SEQ ID NO: 387104 - DNA, 581 bp, Homo sapiens
  misc_feature: GZ8MTXP02GKNO7.22.86.H09.1.454.CMB.2.raw
  modified_base (385)..(385): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaagtaataaagactatgtggactcgtgaaggccgattcaccatctccagagacaactccaaagaacactctcgtttcaccaaatgaacagctgagaggcgagacacggcagtgtattacgngtgacgagagatcgacagtacgacgtaaacggggaaatcgttttaggattcgtacggtacgggggacccaaaggggtaccacgttgggtccctaccgtctccttacgacgtccctaccgaacccgaaaccgggcccctaacgttcccggttcccttcccccgtggccccgtcccgtcgaccttcccgaaggtcccg

SEQ ID NO: 387105 - DNA, 611 bp, Homo sapiens
  misc_feature: GZ8MTXP02IPG6D.22.86.H09.1.454.CMB.2.raw
tcagacatacgcgtcacgaccggtgctcgatttagtgctatagacttgggtttgggctgagcgtgggttttcctcgttgctcttttaagaggtgtccagtgtcaggtgcagctggtggagtctgggggagcgtggtccagcctgggaggtccctgagactctcctgtgcagcgtctggattcacttcagtggctatggcatgcactggctccgcaggctcgggcaaggggctggagtgggtggcaattatatggtatgataggaagtaataagactatgtggactccgtgaaggccattcacatctccagacgacaactccaagaacactcttcgtttacaccaaatcgaacagcctggagaggcgaagacctacgggataggtgtattacgtggtagacggagagaacgtccggaaactagtacgaacggttaaagggtaaacttcgtttagtacttacgtacgggtacggggaaccgtaaagggctacggtcggtacctaccggttctccgttacgaccgtaccgtacccgaaccggaaccggtacccgtaccgttccgttcccgttccccgtccggtcccgtcccgtccgtccgtaccgtacggtacg

SEQ ID NO: 387106 - DNA, 582 bp, Homo sapiens
  misc_feature: GZ8MTXP02JXFT0.22.86.H09.1.454.CMB.2.raw
  modified_base (312)..(312): a, c, t, g, unknown or other
  modified_base (334)..(334): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactatgtggactccgtgaaggccgatcacatcnccagagacaactccaaagaacnctctcgtttcaccaaatgaacagcctgagaggcgagacacggcagtgtattactgtgcgagagagtcgacagtagaacgtaacgggtaaagtcgttttagattctcggtgggaccgaacgggacaacgtggtacctaccgttctccttacgacgtcccgtacccgaaccgaacgggtccccacggttcccggttcccgttcccccgtcgggtccccgtccccgtccgtccgttacccgacggtacccg

SEQ ID NO: 387107 - DNA, 547 bp, Homo sapiens
  misc_feature: GZ8MTXP02FTWJ0.22.86.H09.1.454.CMB.2.raw
  modified_base (318)..(318): a, c, t, g, unknown or other
  modified_base (390)..(390): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgtgaaggccgattcacatctccaganacaactaccaaagaacactctgtttaccaccaaatgaacagcctgagaggcgagacacggcagtgtattacngtgcgagagatcgacatagacgtaacgggaaatctttagatctcgtggggaccaagggacacgtggccaccgtctcttacacgccctaccgaaccgaacgggccctacgtccggttccctcccccgtcggtcccgcccgtcgcctaccgacggaccg

SEQ ID NO: 387108 - DNA, 532 bp, Homo sapiens
  misc_feature: GZ8MTXP02GJO96.22.86.H09.1.454.CMB.2.raw
  modified_base (313)..(313): a, c, t, g, unknown or other
  modified_base (461)..(461): a, c, t, g, unknown or other
  modified_base (498)..(498): a, c, t, g, unknown or other
tcagacatacgcgtcacgaccggtgctcgatttagtgctatagacttgagctctgggagaggagcccagcactagaagtcggcggtttttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggaggtccctgagctctcctgtgcagcgtctggattcaccttcagtggctatggcatgcactggcctccgccaggctccggggnaaggggtctgggagtggggtggcaattatatggtatgagtagggagtaataaaggctatgtaggactcccggtagaacgggccctagttccaacctatctacccgagacgacaactaccaaagacactcttgttacacaaatcgaacngcctagagaggcgaaggacacggcagtgtacttacgngtgacgaagacgagtcgacagtcgacgtaacggg

SEQ ID NO: 387109 - DNA, 645 bp, Homo sapiens
  misc_feature: GZ8MTXP02IF4FD.22.86.H09.1.454.CMB.2.raw
  modified_base (257)..(257): a, c, t, g, unknown or other
  modified_base (442)..(442): a, c, t, g, unknown or other
  modified_base (618)..(618): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggcttcactcagtggctatggcatgcactggctccgccgaggcgtccgggcgaaggggctggaggtgggtggacgaattanagtggtagtgattagggaaagttaaataagtactataggtggtaacctccgtaggaacgggccgtatttaccaccatcctacccagaacgacaacctaccaagaacctactcttacgtttccaccaaatacgaacacgcctaggacgggacgacggacggacacggtacaggttagtatttacgngtcggaggtaagagcgtacgaactgtacgtaacgtaaacggggaatttcgtttgatccggttcgggtacggggacccgtaaggacctcgtcgggtacctaccgttcctcttaccggctaccccgccaaccggacggttacccctcgtcccgggttcccctcccgtaacggggcccncccgttacgccgtaccccaaggggccc

SEQ ID NO: 387110 - DNA, 686 bp, Homo sapiens
  misc_feature: GZ8MTXP02IM2IO.22.86.H09.1.454.CMB.2.raw
  modified_base (286)..(286): a, c, t, g, unknown or other
  modified_base (323)..(323): a, c, t, g, unknown or other
  modified_base (328)..(328): a, c, t, g, unknown or other
  modified_base (333)..(333): a, c, t, g, unknown or other
  modified_base (405)..(405): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggccgtccgggcgaaggggctgggaggtgggtggactaaattatagtggtatgataggaaagtaaanaaagactagtgtggactcgtagaggcgtatcacatcncaganacacncaaagacactctcttacacaatgaacacgctgagacggcgagacgacggctagtgtatacgtgtgacgaganagtacgacgtaatgaaacgtaaacggggtaaatttcgttttagacgtttaccgttacgggtacgggggaaaccgtaaaccgggggtaactccggtttacggggtaccccttaacccgtcgttaacccgtttacgacccggtttacccccaacccgaaacccgggttaaaacccgggccccctaacggtttccccccggggttccccctttaaccccccgggttcgggcccccgtccccccgtttaacggtccccgtaacccccggaagggggtaacccccg

SEQ ID NO: 387111 - DNA, 682 bp, Homo sapiens
  misc_feature: GZ8MTXP02JH8U3.22.86.H09.1.454.CMB.2.raw
  modified_base (279)..(279): a, c, t, g, unknown or other
  modified_base (348)..(348): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtcnggattcaccttcagtggctatggcatgcactggctccgcaggctccgggcaaggggctgggagtggggngcaattatatggtatggatagggaaagtaataaagactaagtggtaggtactccggtaggaacggggaccgtagttaccaacctacgtaccttacccgaaaggaacgaaaccgaaaacgttacccaaaacggaaaacctaaccttaaccgtttacggttttaaccctttaacccgaaaaacgtttacgggaaaccgtaacggacccttaggggaacggaacgggggaccgggaaacggggaaaccggaaccggggaaccggtaacggttaaggttaacgtttaaaccggtgggttaccgggacggtaaacggtaacggaaacggtttaacccgg

SEQ ID NO: 387112 - DNA, 668 bp, Homo sapiens
  misc_feature: GZ8MTXP02F0JTI.22.86.H09.1.454.CMB.2.raw
  modified_base (364)..(364): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacgtccctggagtactctcctgtgcagcgtctggattcaccttcagtggctagtggcatgcacgtggcctcccgccgacggccgtcccggggcgaagggggtctggggaggtcggggtgacctaaagtttanagttgggtataggagtaggggaaataaagttaaaggtactagttggtagggtaccgttaccggtagggtaaacgggcccgtaatttcccaacccgtagtccctaccgaagaacgaaaccctaaacctaccgaaaacgaaacctacttcctttacgttttacccaaccaaaacgttacgaaacgtacgtaccgtaggaacggacggaccgggaaacggaccgaccgggactaagggttagttacgtttaacgtggtacggaacggtaaggaagtacgtaccgaagtacgttaacggtaaaccggg

SEQ ID NO: 387113 - DNA, 750 bp, Homo sapiens
  misc_feature: GZ8MTXP02IDBGS.22.86.H09.1.454.CMB.2.raw
  modified_base (190)..(190): a, c, t, g, unknown or other
  modified_base (259)..(259): a, c, t, g, unknown or other
  modified_base (672)..(672): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtgagtcgtgggggagcggtggtccagccgtgggagtccctgagactctcctgtgcagcgtcngtacttcaccttcagtggctagtggctagtcgcacgtcggcctccgaccgacggtccgtaccggggacgaagggggtctaggggacggttggggtacggaaccttaaaagtttagtaagtaggggttaataggtaaagttaggggtaaaaagtttaaaaactaaaaccggttacttaagttcgggtacgggtaaacccgttacccggggtaaaggaaaccgggggtacccttaactttacccgaaacccgtacgttaccccgttaacccggaaaagaaccggttaaaccaaaacccgtaccgtaaaacgaaaacccttcgtttacccgtttacggtttaacccaacccgttaaaagttaccgaaaacgtcggttacccgaaggaaacggggacgggaaaaccgacgggaaccncggggactaacggggtactttaagttacgtggacgaacggaagaacgtacgaccgaacgtaagtacggtaaaaccggg

SEQ ID NO: 387114 - DNA, 616 bp, Homo sapiens
  misc_feature: GZ8MTXP02FZ0N9.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctagtggcatgcactggcctccgccagggcctcccggggacgaagggggctggggaggtggggtaggcctaaagttatagtggtatggaagtggggaaaagtaaataaaaggacttaagttggtagggaaccttccggtaggtaaacggggccgtaatttccgaacctaatcctaccgaagaacgaaccaactacccaaagaacctactcttacgtttacctaaccaaaatacgaaacacgaccgtaggaacggaacgggacggaagggaccgacgggacgaaggttcgttaacgttacgtggtgaacgaggacgacgtacgaacagtacgtaaacgg

SEQ ID NO: 387115 - DNA, 625 bp, Homo sapiens
  misc_feature: GZ8MTXP02FVRWC.22.86.H09.1.454.CMB.2.raw
  modified_base (313)..(313): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtgactcgtgaaggccgatcacatctccaganacaactccaaagaacactctcgtttactaccaaatgaacagcctgagaggcgagacacggcagtgtattactgtgacgagagatcgacatagacgtaaacgggaaatcgttttaggattcgtacggtacgggggacccaaagggggacctaacgttcggtacccgtaaccgttcctaccgtttaccgacggtaccccttacccgaaacccgaaaccgggggtccccctaacgttccccgggttcccctttaaccccccggtccggggccccgtcccccgttaccggcccttaccccgaacgggtaaccccgg

SEQ ID NO: 387116 - DNA, 555 bp, Homo sapiens
  misc_feature: GZ8MTXP02HSSIB.22.86.H09.1.454.CMB.2.raw
  modified_base (479)..(479): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaaggggctgggagtgggtggcaattatatggtatgatggaaagtaaataaagactatgtggactccggtgaagggccgtattcaaccatctccagagacaactccaaagaacactctacgttaccaccaaatcgaacagcctgagaggcgagacacggcagtgtatacgtgtgcgaagagatcgaacatgaacgtaacgggaaatctttagatcgtacggtgggaccgaagggacacgtggtaccaccgtntaccttcacgtcctacccgaacgaacggccctactcccggtcctcccccgtggccctacccgtgccctacgagccg

SEQ ID NO: 387117 - DNA, 540 bp, Homo sapiens
  misc_feature: GZ8MTXP02GUNVU.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccgaggccgtccgggcgaaggggctggggaggtggggtggaccaagttatagtggtatggatgggaaataaataaagactatggtaggactccgtgaaacgggccgattccactatcctccagacgacaactacaaagacacttctgtttactaccgaaatcgaacagcctggagagacggacgacgacggctaagtgtactacgtgtaggcgaagagacgtacgactatacggtaaacgg

SEQ ID NO: 387118 - DNA, 527 bp, Homo sapiens
  misc_feature: GZ8MTXP02JE315.22.86.H09.1.454.CMB.2.raw
  modified_base (291)..(291): a, c, t, g, unknown or other
  modified_base (355)..(355): a, c, t, g, unknown or other
  modified_base (392)..(392): a, c, t, g, unknown or other
  modified_base (470)..(470): a, c, t, g, unknown or other
  modified_base (506)..(506): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttnagtggctatggcatgcacgtggcctccgccaggcctccggggcgaaggggctggggagtggggngactaattagtagtgggtatggagtagggaaattaanaaagctagtgtggactcggtagaaggcctattcacatctcagagacactacaagacactccgttacaccaatcgaacncgctagacgaggcgagacacggcacgtgtataacgngtacgcgagagactacgaacg

SEQ ID NO: 387119 - DNA, 563 bp, Homo sapiens
  misc_feature: GZ8MTXP02FJCL6.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggggcaaggggctgggagtgggtggcaattatatggtatgatggaaagtaataaagactatgtggactccgtgaagggcgattcaccatctccagagacaactccaagaacactctcgtttctccaaatcgaacagcctgagagggcgaggacacgggcagtgtattactgtgcgagagatcgacatagactaacggggaaagtcttttgaatcgtcgtggggccaaaggggacacgtcggtccaccgtctcttacgacgccctccaaccgaacgggaccctacgtcccggttcccttcccccgtcgggtcccgccccgtcgtccgtccgacgggacccg

SEQ ID NO: 387120 - DNA, 537 bp, Homo sapiens
  misc_feature: GZ8MTXP02GV523.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaaggccgattcaccatctcagagacaactccaagaacactctgtttcaccaaatgaacagcctgagaggcgagacacggcagtgtattactgtgcgagagatcgacagtgaacgtacgggaaagtctttgatcgtcgtggggaccgtaagggacacgtcggaccgtacgtctcttcacgcctaccgacgaaacgggcctacgtccggtccttccccgtcggcccgccctgcctccgaggaccg

SEQ ID NO: 387121 - DNA, 610 bp, Homo sapiens
  misc_feature: GZ8MTXP02IC5UH.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcggtggtccagccgtggggaggtccctgacgactctcctgtgcagcgtctggattcaccttcagtggctatggcatgcacgtcggcctccgccgaggccgtcccggggacgaaggggcctaggggaggtggggtggtcctaagttatagtggtatggatggaaagttaaataaagacttagtggtagtactcgtaggaacggcctattccacgtactctacaagacgacaacctaccaaacgaactacctttctttacgtttacctaacctaaagtaccgaaactaacgtccctaggaacggagggaccggaaacgggaccgaacgggactaaggtacgttaacttacgtagcggtaagaaggacgacgtacgaacgaggttacggtaaaccgg

SEQ ID NO: 387122 - DNA, 549 bp, Homo sapiens
  misc_feature: GZ8MTXP02I19NI.22.86.H09.1.454.CMB.2.raw
  modified_base (389)..(389): a, c, t, g, unknown or other
  modified_base (528)..(528): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggcaaggggctggagtgggtgcaattatatggtatgatggaaagtaataaagactatgtggactccgtgaaggccgattcaccatctccagagacaactccaaagaacactctcgtttcacaaatgaaacagcctggagaggcgaggacacggacagtgtattacngtgcgaagagatcgacagtagactaacggggaaatctttaggattctcgtaggggccaaggggacacgtgggctaccggtctcgttcagccctaccaaccgtaacgggccctacgtcccggtccttcccccgtcggccnccccgtgaccctccgagaccg

SEQ ID NO: 387123 - DNA, 625 bp, Homo sapiens
  misc_feature: GZ8MTXP02GR006.22.86.H09.1.454.CMB.2.raw
  modified_base (239)..(239): a, c, t, g, unknown or other
  modified_base (270)..(270): a, c, t, g, unknown or other
  modified_base (314)..(314): a, c, t, g, unknown or other
  modified_base (337)..(337): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgatgttggtgttataactatgtctctgtaccangcaccagcaaacgccccagactcatcattangctgtcaatacgccggcctcgacggggtccctgactcgtcttcnctggctccgagtctcggacaacnccggtcctccctcgaccacgtccgtccgtcgggcctaccgaggtacctaggaaagtcgtaggaggtctagtaactttactcgtagtctgtaccttctagtttcgcgtacggccgtaccgtacgtacggttcggggttcggttaccgggcggggtaacggtaccgaacggtccgttacggaaccccggtttccggtacggtaccgaaccggtccccggaaacggtccgtccccggtcccccgtaacggtccctaccgttccgtcccggttcccctacccctcgtacccg

SEQ ID NO: 387124 - DNA, 565 bp, Homo sapiens
  misc_feature: GZ8MTXP02JU30J.22.86.H09.1.454.CMB.2.raw
  modified_base (253)..(253): a, c, t, g, unknown or other
  modified_base (391)..(391): a, c, t, g, unknown or other
  modified_base (410)..(410): a, c, t, g, unknown or other
  modified_base (416)..(416): a, c, t, g, unknown or other
tcagacatacgcgtcacgaccggtgctcgatttagtgctatagacttgggtttgggctgagctgggttttcctcgttgctcttttaagaggtgtccagtgtcaggtgcagcgtggtggagtcgtgggggaggcgtggtccagcctgggaggtccctgagactctcctgtgcagcgtctggattcaccttcagtggctatggcatgcactggctccgcaggctccgggcaaggggctggagtgggtgcaattanagtggtatgatggaagttaataaagactatgtggactccgtagaaaggccgtattcaccagtctccagacgacaactccaaagtaacacttctacgtttcaccaaatcgaacagcctgagaggcgagacacggcagtntagttactcgtgcgacganatcganatacgacgtaacggggaatcgtttgactctcggtagggaccgaagggacacgtggtcctaaccgtctacttcgacgtcctaccgaccgaacgggcccacgttccggtacccttcccccgtggcccgtccctcgaccttccgaggacccg

SEQ ID NO: 387125 - DNA, 649 bp, Homo sapiens
  misc_feature: GZ8MTXP02FT3YY.22.86.H09.1.454.CMB.2.raw
  modified_base (362)..(362): a, c, t, g, unknown or other
  modified_base (611)..(611): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcgtctggattccaccttcaggtggctagtggcatgctacgtggcctcccgccgagggccgtccggggcgaagggggctggggaggtggggtcggacctaaagtttanagttagggttataggtaatagggggaaaattaaaacgtaaaaggacttaagtcgggtacggtaacgttccgggtaggaaacggggtcctaacttccgaacctatcccgtaccgaaggtaacgaaacccaaactaccgaaaacgaaacctacttcgttactttacctaaccaaaattgaaaaccagtacctaggaacgacggggaccggaaacggacccggaacgggactaaggttacgttaattaacgngtacgaaggaagacgactacggaactagtacgaaacgg

SEQ ID NO: 387126 - DNA, 565 bp, Homo sapiens
  misc_feature: GZ8MTXP02F5J2P.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcgtctggattcaccttcagtggctatggcatgcactggctcccgcgaggcctccggggcaagggggctggggaggtggggtggcctaagttatagtggtatgatgggaaataaataaagctagtgtaggactcgtgaaggcattcacatcctacagacgacaactaccaaagaacacttcttacgtttactaaccaaatcgaaacacgtaccgtaggaaggacgggacgaacgggaccgacgggactaaggttacgttaattacgtggtaggaacggaagagtacgtacggaactagtacggtaaaccgg

SEQ ID NO: 387127 - DNA, 572 bp, Homo sapiens
  misc_feature: GZ8MTXP02I675I.22.86.H09.1.454.CMB.2.raw
  modified_base (226)..(226): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctggagtgggtgcaattatatggatgatggaataataaagactatgtggactcgtgaaggccgattcaccatctccagagacaactccaaagacactctcgtttccaccaaatgaacacgcctgagagggcgaggacgacggtacagttctaagtttacgtggtagacgagaaagcgttacgaacagtacgaacgtaaacgggggaaattccgttttagattcgtacggttagggggaccctaaggggacacgtcggtaccaccgtcttccttcgacgtccctacgaaccgaacggccctacgtccgtcctccccgtcggcctccgagcctcgacgaccg

SEQ ID NO: 387128 - DNA, 573 bp, Homo sapiens
  misc_feature: GZ8MTXP02HRT44.22.86.H09.1.454.CMB.2.raw
  modified_base (240)..(240): a, c, t, g, unknown or other
  modified_base (275)..(275): a, c, t, g, unknown or other
  modified_base (402)..(402): a, c, t, g, unknown or other
  modified_base (544)..(544): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccagccgtgggagtcccngagactctcctgtgtagcgtctggacttcaccttnagtggctagtggcatgccactcgacctcccgccgaggccgtaccggggacgaacgggggctaggggaggttggggtagactaaagtttagtagtggtatggaagtaggaagtaaataaagctagtgngactcgagaaggcctatcactatcacgagacgacaactacaaagacctactctttacgtttaccaaccaaagtacgaaccacgtaccgaggacggaggaccgaaggtacgacggtatagtagttaatcgtagagagaagganacgtacgaacgacgtacgtaacgtaacgg

SEQ ID NO: 387129 - DNA, 534 bp, Homo sapiens
  misc_feature: GZ8MTXP02FM2XI.22.86.H09.1.454.CMB.2.raw
  modified_base (343)..(343): a, c, t, g, unknown or other
  modified_base (516)..(516): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcacatctccagagacaactccaaagaacactctcgtttcnccaaaatgaacagcctgagaggcgagacacggcagtgtattactgtgcgagagatcgacatagacgtaacgggaaagtcgttttgattctcgtggggaccaaggggacacgtggtcacgtctcttcacgcctccaaccaacgggccctacgtccgtccttcccccgtggcccncccgtgcctccaggaccg

SEQ ID NO: 387130 - DNA, 664 bp, Homo sapiens
  misc_feature: GZ8MTXP02HXYDT.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattagtatggtatgataggaaagtaaataaagactagtgtggactccgtaggaagggccgtattccaaccatcctaccaagaacgaacaaacctaccaaaagaaaccactcttacgtttacctaacctaaaagtacgaaacgacgacctggaacggaaggaccggaaggaccgaacgggactaaggttagtaaacttacgtggtcgacgaagaggactacggaacaagttacgaaacgttaaaccggggaaaattcgttttagactttcgtacgggtacgggggaccaaaaggggccaacggtgggttacccaccggtcttacttccgaacgtccctaccaacccggaacgggtcccctacgttcccggtccctttcccccgcgggcccgtccctcgccctaccggaacggacccg

SEQ ID NO: 387131 - DNA, 641 bp, Homo sapiens
  misc_feature: GZ8MTXP02J0CTQ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacgtccctgagactctcctgtgcagcgtctggattcaccttcagtggctatggcagtgcacgtggcctccgccgaggccgtcccgggagaaggggctggggaggtcggggtagacctaaagtttatagttaggggtataggaagttaggggaaaagttaaaataaaaggtacttaagtgggtacggaaccgtacccggtaggaaacggggcccgtaatttacccgaacccagttccctacccgaagaacgaactaacctacccaaaagaacctacctcttacgtttacctaaccgtaaaatcgaaacctacgacctagaggacgggacggaacggaacgacggacgtaggtacgttaagtaccgtagtcggaacgaggaagacgtacgaccgtagtacggtaaaaccggg

SEQ ID NO: 387132 - DNA, 723 bp, Homo sapiens
  misc_feature: GZ8MTXP02H94MC.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggacttcaccttcagtggctatggcatgcacgtggcctccgccaggccgtccgggcgaaggggctggggacggtggggtggacctaaagtttatagtaggggttataggaattaggggaaaagtttaaaagtaaaacgtacttaaagtggtacgggtaaacccgttcccgggtagggaaacggggtcccgtaatttacccaacccgtacttccgtacccaaggaacgtaaccaaaaccgttacccgaaaacggtaaacccttaaccgtttacctttacggttttaccctaacccgtaaaaacgttacgggaaaacccggttacggaccggtaagggaacgggtacggggaaccggaacgggaaccgggaccggtaacgttacgggttactttaaacgtacggttcggtagggaaccgacgggtaaacgtacggtaacgacggttaacgtaacggtaaaccgggg

SEQ ID NO: 387133 - DNA, 593 bp, Homo sapiens
  misc_feature: GZ8MTXP02GH0FV.22.86.H09.1.454.CMB.2.raw
  modified_base (379)..(379): a, c, t, g, unknown or other
  modified_base (390)..(390): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagatatgtggactccgtgaaggcgattcacatctccagacgacaactccaaagaacactcttcgttactaccaaatgaaacagcctggagaggcgagacacggnagtgtattacngtgcgaagagatcgacatgaacgtaacgggaaagtcttttgaatcgtacggtaggggaccaaggggactacgtagggtacctaccggtctacgttaccgacgtaccttaccccgaaaccgtaaacggggccccctaacgttcccgggttccccttaacccccgtcgggcccgtccccgtacggccctaccggacggtacccgg

SEQ ID NO: 387134 - DNA, 676 bp, Homo sapiens
  misc_feature: GZ8MTXP02GE4WU.22.86.H09.1.454.CMB.2.raw
  modified_base (232)..(232): a, c, t, g, unknown or other
  modified_base (266)..(266): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctgtaccaangcacccaggcaaacgccccagactcatcatttangctgtcaataacgccggcctcgacgggtccctgatcgtcttctctggctcaagtctcggcaaccgaccggcctccctagaccacttctcgtcgggcctaccgaggccttaggaaacgtagtcgaggtcctagtactttaacttacgtcgtccttgtccttacgtagtttcgaccgtacggaccgtcctaaccgttaccggtttcgggggttcggttaccggggacgggtaacggggaacccgtaaacggtccgtacggtaccccggttaccgttaacgggtacccgacgggtacccccgtaaacggggtcccgttaccccggtccccccgttccgggtaccctaacccgttcccgttacccggtttccccccggtacccccttcccgtacccgtaacccggtttacccgg

SEQ ID NO: 387135 - DNA, 531 bp, Homo sapiens
  misc_feature: GZ8MTXP02HTAMY.22.86.H09.1.454.CMB.2.raw
  modified_base (312)..(312): a, c, t, g, unknown or other
  modified_base (329)..(329): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccagcctggggaggtccctgagactctcctgtgcagcgtctggattcaccttcagtggctatggcatgcatggctccgccaggctccgggnaaggggctggagtgggnggcaattatatggtatgatgggaaagttaaataaagacttaagtggtaggacctccggtagaaaggggcccgattccaccgtatcctccagacgacaactaccaagaacactctgtttacaccaaatcgaacacgcctagagaggcgaggacgacggacaggtgtacttacgtgtgcgagagatacggacagtacgtaacgg

SEQ ID NO: 387136 - DNA, 597 bp, Homo sapiens
  misc_feature: GZ8MTXP02JFPC4.22.86.H09.1.454.CMB.2.raw
  modified_base (340)..(340): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggagcgtggtccagcctgggaggtccctgagactctcctgtgcagcgtctggattcaccttcagtggctatggcatgcactggctccgccaggctccgggcaaggggctggagtgggtggcaattatatggtatgatggaataataaagactatgtggactccgtggaaggccgattcaccatctccagacgacaactcaaagacactctgtttcnccaaatgaacagcctgagaggcgagacacggcagtgtattactgtgcgtagagtagcgtaacagtacgaacgtaaaccggggaaagtcgtttttacgaacgttcgtacggttcggggaccgaaaacgggggacaacggttcggtaccgaacccgttcgtcctttacgaccgtcccgttacccaacgaaaccggggccccaacgttcccggtcccttcccccgtggaccctcccccggacttcccgacggacgccccc

SEQ ID NO: 387137 - DNA, 599 bp, Homo sapiens
  misc_feature: GZ8MTXP02HS49X.22.86.H09.1.454.CMB.2.raw
  modified_base (317)..(317): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggagtccctgagactctcctgtgcagcgtctggattcaccttcagtggctatggcatgcactggcctcccgcagggcctccggggngaaggggctggggaggtggggtagacctaaagtttatagtgggttatggaattaggggaaattaaaataaagacttagtcggtagtaccgtccgtaggaacgggtctagttccaaccctataccctacaagaacgaaccaaacctaccaaagaactacctttcttacgtttaccacctaaaatcgaaacacgacctaggaacggacggacgaacggaccgacggactagttagttacttacgtgtgaacggtagaacgtctacgtaacagtacgtaaaccgg

SEQ ID NO: 387138 - DNA, 578 bp, Homo sapiens
  misc_feature: GZ8MTXP02HPOEU.22.86.H09.1.454.CMB.2.raw
  modified_base (336)..(336): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtggcaattatatggtatgataggaaagtaataaagactatgtggactccgtgaagggccatcaccatctcagagacaactaccaaagaacnctctcgtttacaccaaatgaacacgctgagaggcgaggacacggcagtgtattactgtgcgagagatacgacatagaacgtaaggggaaattcgttttagacgttcgtcgggtacgggaccgaaaggggcctagtcgggtaccaccgttctccttacgacgtccctaccaaccgtaacgggccctacgttcccggtccctttcccccgcgggccctccccgtcgccctaccgtaacggcccg

SEQ ID NO: 387139 - DNA, 730 bp, Homo sapiens
  misc_feature: GZ8MTXP02HODZB.22.86.H09.1.454.CMB.2.raw
  modified_base (188)..(188): a, c, t, g, unknown or other
  modified_base (226)..(226): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcactggctccgcaggctccgggngaaggggctgggaggtgggtggactaaattagtagtggtatgaagtagggtaaagtaaataaagactagtggtaggactccggtaggaacggggccgtaatttccgaacctatccgtaccaaggtaacgaaacctaaactaccaaaaagacctaccttcgttaccgtttaccaacctaaaatacgaaacgacgtccgtggaaacggacggaccgaagggaaccgtaacgggactaaggtagttaacttaacggtggtacggaacggagtaagtaacgtacgaaactacgtacggtaaaccggtaaacgggtaaatttcgtttagtattaccgtacggggtacggggaacccgaagggtaaccacggttacgggacccttacccgttcttacccgttacgacccgtccccgtaaacccgaccggtaaacccgggtcccctaacggttccccgttcccgttcccccggaggccccctcccgtacgtccctaccggaaacggccccg

SEQ ID NO: 387140 - DNA, 600 bp, Homo sapiens
  misc_feature: GZ8MTXP02JO2AD.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcacgtggctccgccaggctccggggcaaggggctgggagtggggtggacctattatagtaggtatggatggggaaagtaaataaacggtactaatggtacggacgtccggtaggaaacggggcccgtattccaacccatcctaccgaaggacaacaaacctaccaaagaaacctactactacggttttaccaacccaaattacgaaacacgccgttaggagggacggcgaaacgggacgtaccgggacacggttcggtaatttacgtcggtacggaacggacggaacgacgtacgtacgtacgtacggtaacgg

SEQ ID NO: 387141 - DNA, 642 bp, Homo sapiens
  misc_feature: GZ8MTXP02GO3YQ.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggattcaccttcagtggctatggcatgcacgtggcctcccgcaggccgtccggggagaaggggctggggagtggggtgactaagtttagtagtggggtataggaagttagggaaaacgttaaagtaaaagtacttaagtaggtacggtaacgtccggtaggaacggggtcctacgttccaacctatcctaccgaagaacgaaccgaaactaccgaaaagaaccctaccttaccgttacgtttacctaaacctaaaagttacgaaaccgtacgtacccgtaggaacggacgggacggaaacgggaacgacggacgtaaggttagttaacgttaacgtggttacggacgaaggacgtacgtaaccg

SEQ ID NO: 387142 - DNA, 633 bp, Homo sapiens
  misc_feature: GZ8MTXP02I1A21.22.86.H09.1.454.CMB.2.raw
  modified_base (274)..(274): a, c, t, g, unknown or other
  modified_base (317)..(317): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggaggcgtggtccagccgtgggaggtccctgagactctcctgtgcagcgtctggattcaccttnagtggctatggcatgcactggcctccgccaggcctcccggggngaaggggctggggaggtggggtcggcctaaattagtagtgggttataggattaggggaaaagttaaactaaaagtacgtaattgggtagggaccttccgggtaggaaacgggcccgtaattccaaccgtatcccgtacacgaagaaccaacctaaccgaaagaacctacttcttacgtttacctaaaccgaaattcgaaacacggtacctagggaacggacgggaccggaagggacccggaccggtcgaaggtttaccgtagttttaaccggtggtaggaaccggagtacgtaacgtacgaactagtacggtaacg

SEQ ID NO: 387143 - DNA, 600 bp, Homo sapiens
  misc_feature: GZ8MTXP02JN4Z0.22.86.H09.1.454.CMB.2.raw
  modified_base (412)..(412): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctgggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaaataaagactaagtggtggactccggtggaagggccgattcaccatctccagacgacaactccaaagaacactctcgtttactacaaatgaacagcctgagaggcgaggacacggcagtagtatactgtgcgagagancgaacatacgaacgtaacggggaaagttcttttaggattcgtacggtaggggacccgaaaggggacctacgtcggtacctaccggtctccttcgacgtccctacccgaaaccgtacggggacccctacgttcccgggtcccttcccccgtcgggcccgtccccgttacgccctacccggacggacccg

SEQ ID NO: 387144 - DNA, 613 bp, Homo sapiens
  misc_feature: GZ8MTXP02JMZWJ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgacgactctcctgtgcagcgtctggattccaccttcagtggctagtggcatgcacgtggcctccgccgaggccgtcccgggagaaggggctaggggacggttggggtgacctaaatttagtagtgggtataggaataggggaaaattaaaagtaaacggacttagtggtacgactccgaggaacgggctattacacctatcctacagacgaacaactacgaaagtaaccacttcgttacgtttaccaaccgtaaaagtcgaaacctcgtacctaggaacggacggacgaacgggaccgaccgggactaaggttacgttaattaccgtggtagaacggaagaagtacgtaccgaaactaggtacggtaaaaccgg

SEQ ID NO: 387145 - DNA, 671 bp, Homo sapiens
  misc_feature: GZ8MTXP02FU6VM.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagctctcctgtgcaggcgtctggattcaccttcagtggctatggcatgcacgtggcctcccgccgaggcctcccggggcaaggggctggggaggtggggtggcctaattatagtggtatgaataggggaaataaataaaacgctagttggaggactccggtagaacgggccgaattcgacctagtcctaccgagaacgaaaccaactacccaaaagaaaccctacttacgttacgtttacctaacctaaaacgttacggaaacctacggtacccgttagggaaacgggaacgggaccgggaaaacgggaaacccggaaccggggaaccgtaaaggggtttacgttaaacgttttaacccgtggggttacggtaaccgggaacggtaaacggagttaccccgaaacgtaaggttacggttaaaaacccggggg

SEQ ID NO: 387146 - DNA, 600 bp, Homo sapiens
  misc_feature: GZ8MTXP02GSO95.22.86.H09.1.454.CMB.2.raw
  modified_base (241)..(241): a, c, t, g, unknown or other
  modified_base (344)..(344): a, c, t, g, unknown or other
  modified_base (352)..(352): a, c, t, g, unknown or other
  modified_base (358)..(358): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaacgccccagactcatcatttatgctgtacaataagccggccctcgacggggtcccctgactcgcttctctggctccaagtctcggcaacncgcctccngacctntctcgtcgggctccgagctagaagatggagtctagtaatttatactgctgctctatttcgcgtacggtcgtcccttaacgtaccgtttggggtcggttcggggacggggaacggaccgaaacggcgtacggtacccgttaccgtaggtaccaacggaccccgaacgggtccctccggtccccccgtcgggtaccctacccgtttacccgtcccgttaccccctaccccgtttccctacccgg

SEQ ID NO: 387147 - DNA, 528 bp, Homo sapiens
  misc_feature: GZ8MTXP02JTU70.22.86.H09.1.454.CMB.2.raw
  modified_base (288)..(288): a, c, t, g, unknown or other
  modified_base (417)..(417): a, c, t, g, unknown or other
  modified_base (464)..(464): a, c, t, g, unknown or other
  modified_base (467)..(467): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggattcaccttcagtggctagtggcatgcncgtggctccgccaggcctccgaggtcaagggggctggggaggtggggtcggactaagttatagtggtaatggagtagggaaagttaaataaagacttagtggtaggactcggtaggaggccgtatcacntctacgagacgacaaactcaaagacactctacttctacaaatcaacngcngagaggacgagacgacggcaggtgtactacgtgtaagcggagtagataccgacgagtacgg

SEQ ID NO: 387148 - DNA, 576 bp, Homo sapiens
  misc_feature: GZ8MTXP02G11MY.22.86.H09.1.454.CMB.2.raw
  modified_base (191)..(191): a, c, t, g, unknown or other
  modified_base (268)..(268): a, c, t, g, unknown or other
  modified_base (275)..(275): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgtaggctctttaagaggtgtcagtgtcaggtgcagntggtggagtcgtgggggagcgtggtccagccgtgggaggtccctgagctctcctgtgcagcgtgtggattcaccttnagtgctnggcangcncgtcgcnccgccgcggcgtccggcggaacggcgtggtggtgggtggtacgtatagtagtagtagtagtagtaggtaaagtaaagtaaagtaagttaagtgttaggacgtaccgtaggtaaggtacggacgttactaccgactcctaccgaacgacgaacaaccaacaacaactactacttacttactaactaaacacgaacgacgtacgtagagacggacggaacggacgacgacgtagtacgttacgtacgtagtagaaggacgacgtacgtacgacgtacgtacggtaacg

SEQ ID NO: 387149 - DNA, 602 bp, Homo sapiens
  misc_feature: GZ8MTXP02GX5KN.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtctggattccaccttcagtggctagtggcagtgcacgtggcctcccgccaggccgtcccgggcgaaggggctggggaggtggggtggacctaaattatagtgggttatggtaagtggggtaaaattaaaagtaaaacgtacttaagtggtacgggtaccgtaccggtaggaaacggggtccgtattaccaacctatcctaccaagaacgaacaactaaccaaagaaacctactacttacgtttacctaaccaaattacgaaacacgaccgtagaacgaggaccggaaggaccacgggactagtacgtatacgtgtagaagagacgatcggaactagtagtaacgg

SEQ ID NO: 387150 - DNA, 648 bp, Homo sapiens
  misc_feature: GZ8MTXP02IAA7V.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagccgtgggagtccctgagactctcctgtgcagcgtctggattcaccttcagtggctagtggcatgcacgtggcctccgccaggccgtccgggcgaaggggctggggaggtggggtggacctaaagtttagtagtgggtattggaattaggggaaaattaaaagtaaaacgacttaatgggtacgggtacctccgggtaggaacgggggacctattaccacctaatccgtaccaaggaacaccaactaccaaagtaaccacttctacgtttacccacctaaaagtacgaaacaacgtccgtaggaaacgaaggggacccggaagggaacccgtaaaccggggtacgtaaaggttacgtttaacgtacggttaggacggaacggaaagaacggtacgtacggaactaacggtaacgggtaaaccgg

SEQ ID NO: 387151 - DNA, 684 bp, Homo sapiens
  misc_feature: GZ8MTXP02GC5IV.22.86.H09.1.454.CMB.2.raw
  modified_base (255)..(255): a, c, t, g, unknown or other
  modified_base (260)..(260): a, c, t, g, unknown or other
  modified_base (633)..(633): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagccgtgggacgtccctgagacctctctgtgcngctgngtatctctcagtcgctagtggacagtcgctacgtggtcctcccgacgacgggtccgtcccggggacggaacgggggtcgtaggggtaggggtggggtacgtaccgttaaaagtttagtagttaggggttactaaggttaagtaggggtaaaattaaaacgtaaaacgtacttagttagggtacggtaacccgtcgggtaaacggaacggggtccctaattacccgacctatccgtacgaagtacgaaacctactaacgaaacgaactccttagttactttaaccaaacctaaagcgaaaaccgcgttaccgagggaaaggacggaacggaaccgacggaccggaacgttaggttaaagtttaccgttaacggnggtacgaacggtaagacgtaacgacgtaacggtaacggtaacggtaaacgg

SEQ ID NO: 387152 - DNA, 621 bp, Homo sapiens
  misc_feature: GZ8MTXP02FU7B7.22.86.H09.1.454.CMB.2.raw
  modified_base (274)..(274): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggaggcgtggtccagccgtgggacggtccctgagactctcctgtgcagcgtctggacttcaccttnagtggctagtggcatgcacgtggcctccgccgaggccgtcccggggacgaacgggggccttggggacggtggggtcgacctaaagtttagtagtgggtatggaacttgggggaaagttaaaactaaaaggtactagttgggtacgggtaccttccgggtaggaaacggggtccgtaacgtttaccaacctatcctaccgaagacgaacaacctaccaaaagacctactcttacgtttacacctaaatcgaaacgtagaccgtaggaagacgggacgaacgggacacgggactaaggttacgtattacgtggtacgaaggtacgagactcgatacgtacggtaaacgg

SEQ ID NO: 387153 - DNA, 717 bp, Homo sapiens
  misc_feature: GZ8MTXP02JRZK2.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcagtggctatggcatgcacgtggctccgcaggctccgggcaggggctggaggtggggtggacctaagttatagtggtatggaatggggaaagttaaataaagtactagtggtaggacgtccgtaggaaagggcccgtatttccgacctaatcccgtacccgaaggtacgaaccctaaacttacccgaaaaggtaaaccctaaccgttcgtttacgttttaccctaccctaaaaaagttccggtaaaaccgacgggtacccccttagggggaaaacgggaacgggggacccggtaaaacgggggaaccccgtaaaccgggggccgtaaaacgggtttacggggtttaaactttaacccgtttcgggggtagggtaacccggggtaaaagggaaccggtaagtaccccggggtaaaacttaaccgggtaaggtttaaaaccccggggg

SEQ ID NO: 387154 - DNA, 560 bp, Homo sapiens
  misc_feature: GZ8MTXP02IZECZ.22.86.H09.1.454.CMB.2.raw
  modified_base (441)..(441): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggaggcgtggtccagcctgggacgtccctgagactctcctgtgcagcgtctggacttccaccttcagtggctagtgggcagtcgccacgtcggcctcccgccgacggccgtccggggacgaaggggctgggaggtgggtgactagttatagtggtatggataggaagtaataaagatagtgtcgacgtcgtaggacggcgtatcgacactcncagacgaacacctaccaacactactcttacgttactacaaatacgaacacgcgtaggacgacggacgacggacgacggacgtagtagtaacgtacgtggtagacggacgtagactaacg

SEQ ID NO: 387155 - DNA, 568 bp, Homo sapiens
  misc_feature: GZ8MTXP02GVWVU.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggcgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaaataaagactatgtggactccgtgaagggccgattcaccatctccagagacaactccaaagaacactctcgtttctaccaaatgaacagcctggagaggcgaggaccacggcagtgtattactgtgcgagagatcgacagtgacgtaacgggaaatcttttagatcgtcggtacggggaccaaggggacacgtcggtccaccggttctccttacacgtccctaccgaaccgaaacgggcccctacgttcccgggttcccttcccccgtggccctcccgtgccctcccgagggtacccg

SEQ ID NO: 387156 - DNA, 604 bp, Homo sapiens
  misc_feature: GZ8MTXP02JXJ5R.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatagtggtatgatggaaagtaataaagactatgtggactcgtgaaggccgattcacatctcagagacaactaccaaagaacactctcgtttacaccaaatgaacagcctgagaggcgagacacggcagtgtattactgtgacgagagactcgaacagtacgaaacgtaacgggtaaagtcttttaggattccgtacgtacgggggacccaaaggggacctaacggttcgggtacctaacccggttctcgtttaccgaacgtcccctacccgaaaccgaaacggggccccctacgttcccgggtcccttcccccggtcggcccggtccctacggcctacccggaaggaccccg

SEQ ID NO: 387157 - DNA, 540 bp, Homo sapiens
  misc_feature: GZ8MTXP02HGTNL.22.86.H09.1.454.CMB.2.raw
  modified_base (192)..(192): a, c, t, g, unknown or other
  modified_base (410)..(410): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagcttgggttttcctcgttgctcttttaagaggtgtccagtgtcaggtncagctggtggagtcgtgggggagcgtggtccagcctgggaggtccctgagactctcctgtgcagcgtctggattcaccttcagtggctatggcatgcatggcctccgccaggcctccggggacaaggggctgggaggtgggtgactaaattatacgtggtaatgaatgggaaagttaactaagacttagtgtagacttcggagaacggcatcacatcnccagacacaacaccaagacactcttgttctacaaatgaacagaccgtagaggacgcgaggacgacggacagtgtacttacgtagtgacgagaagcgtacgaacacgttagacgttaacgggaaagtttcg

SEQ ID NO: 387158 - DNA, 609 bp, Homo sapiens
  misc_feature: GZ8MTXP02HYR9H.22.86.H09.1.454.CMB.2.raw
  modified_base (401)..(401): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggaggcgtggtccagccgtgggagtccctgagactctcctgtgcagcgtctggacttcaccttcgagtggctagtggcatgccacgtggcctcccgcgacggccgtccggggacgaaggggctggggaggtggggtgactaagttatagtggtatagagtaggaaagtaanaaagtactagtgtacggactcggtaggaacgggtcctagttcaccatcctacgaagacgaaacctaactacaaacgtacctacttctacgtttaccaacgaaaatacgaaaactcgtccgtaaggacggtaacgggacgaaacgggaaccgacgggacgtaggttacgtaacgtttacgtaggtacgaacggtacgaagtactaacgg

SEQ ID NO: 387159 - DNA, 892 bp, Homo sapiens
  misc_feature: GZ8MTXP02FZYA3.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctctgtgcgagcgttcgtggtacttccacctttcgaggtggaccttagtcgggctaagttgccgtacgttcggccctccccggacccgaggggccccgtcccgggggacgtaaacgggggggtccttagggggtaacggtgggggttacggaccttaaaagttttagtagttaggggtaattaggaagttacgggggtaaaattaaaacgttaaaaggtaccttaaggttcgggttaggggtaacccgtttacccgggtaaggggtaaaaccgggggtcccggtaaacttttacccgaaacccgttacgtaccccgttaaccgaaacggtaaccgaaaacccctaaaacccgttaaacccgaaaaaccggtaaacccttaaccctttacccgtttaacggttttttaaccccgaaaacccttaaaaacgttaccggaaaacccggtaacgtaccccggttaagggaaacgggtaaaccgggggaacccgggtaacgggggaaaacccgtaacccgggggtaacggtaaacgggtttacggtttaaaacggttttccggttaggggtttaacgggaaccgggtaaaacggaacggttaacgtaaccgggttaaaccgtaaaggtttaaccggggttaaaaacccggggg

SEQ ID NO: 387160 - DNA, 681 bp, Homo sapiens
  misc_feature: GZ8MTXP02GAZMZ.22.86.H09.1.454.CMB.2.raw
  modified_base (341)..(341): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggcctccgggcaaggggctgggagtgggtggactaattatagtggtatgataggaaagtaataagatatgtggactccggtgaaggccgtattcaccatctccagacgacaactccaaagaacncttctcgtttacaccaaatacgaacacgctggacgaggacgaggacacgggactacgttagttacttacgtggtagacgaagagacgtacgaacagtacgaaacgttaaacggggtaaaagttcgttttaacgacgttcgtaccgggttacgggggaaccccgtaaaggggaccctacggttacgggtacccgtaacccggttccttaccgtttaccgaccgtacccccgttacccgaaaccccggtaacggggacccccgttacgttccccggtttcccccgttcccccggtccgggtcccgtccccgttaccgcccgttacccggaacggaaccccgg

SEQ ID NO: 387161 - DNA, 548 bp, Homo sapiens
  misc_feature: GZ8MTXP02G8ZUF.22.86.H09.1.454.CMB.2.raw
  modified_base (279)..(279): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggaggcgtggtccagcctgggaggtccctgagactctcctgtgcagcgtctggattcaccttcagtggctatggcatgcactggctccgccaggctccgggcaagggctggagtgggtgcaattatatggtatgatggaataataaagactatgnggactccgtgaaggccgattcaccatctccagagacaactccaaagacactctgtttctccaaatgaacagcctgagaggcgagacaacggcagtgtattactgtgcgagagatcgacatgacgtacgggaaatctttaggaattcgtacgtggggtaccaaagggacaacgtggtacaccgtctccttacgacgccctaccgaaccgaacgggccccaacgtccggttaccttcccccgtggcccgtccctcgcctacccgaggaccg

SEQ ID NO: 387162 - DNA, 608 bp, Homo sapiens
  misc_feature: GZ8MTXP02G4TG8.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaaataaataaagactatgtggactcgtagaaggccatcacatctcagagacaactcaaagaacactctcgtttaccaccaaatcgaacagcctgacgaggacgaagacacggctaggtgtattactgtacgacgagagtactacgaacagtacgaacgttaaacggggaaatcgttttaggatcgtacggtacggggaccaaaggggactacggtcggtaccaaccggtcttacttaccgacggcccctaccaaccgaaaccgggtcccctaacggttcccggttaccccttcccccgtcgggtccccgtccccgttcgacccgtacccggaaggtaaccccg

SEQ ID NO: 387163 - DNA, 583 bp, Homo sapiens
  misc_feature: GZ8MTXP02FVMMZ.22.86.H09.1.454.CMB.2.raw
  modified_base (345)..(345): a, c, t, g, unknown or other
  modified_base (573)..(573): a, c, t, g, unknown or other
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctctgtgcagcgtctggattcaccttcagtggctatggcatgcactggctccgccgaggcgtccgggcgaaggggctggggagtggggtggacctaagtttanagtggtatagtaagtgggtaaaagtaaataaaaggacttaagtagggtacgggacttacccgggtaggaacggggtacccgtaatttccaaccctaatcctacccgaagacgaaaccaactaccaaagaaccactcttcgtttacaccaaaactcgaacacgtcctagaagacggacgacggacgacggcgtagtggttactacgtgtgaacgagactagcgaactanagtaaaccgg

SEQ ID NO: 387164 - DNA, 664 bp, Homo sapiens
  misc_feature: GZ8MTXP02HZER6.22.86.H09.1.454.CMB.2.raw
  modified_base (317)..(317): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctctttttaagaggtgtccagtgtcaggtgcagctggtggagtcgtgggggaggcgtggtccagccgtgggaggtccctgagactctcctgtgcagcgtctggattcaccttcagtggctatggcatgcactggcctccgccaggccgtccggggngaaggggctgggacggtggggtggacctaagtttatagtaggtataggataggggaaattaaataaagacttaagtggtagtaaccgtccggtaggaaacggggtcctagttaccaacctatcccgtaccaagacgaacctaacctaccaaacgaaacctacctttacttacggtttacctaaccccaaaagttccggaaaactacggtacccgttaggaaacgggaacgggaccggaaacgggacccgaacgggggtacctaaaggggttacttaacgtttaccgtaggttacggaaccggtaggaacgtacgtaccgtaacgtacggtttaacggtaaacccggg

SEQ ID NO: 387165 - DNA, 678 bp, Homo sapiens
  misc_feature: GZ8MTXP02H8T6F.22.86.H09.1.454.CMB.2.raw
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagctgggttttcctcgttgcttcttttaagaggtgtccagtgtcaggtgcagctgggtggagtcgtgggggagcgtggtccagccgtgggacgtccctgagactctcctgtgcagcgtctggacttcaccttcgagtggctagtggcatgccacgtggcctccgcgacggccgtccggggacgaaggggctggggaggtggggtgacctaaattagtagtggtatgagtaggaaagtaaaataaaaggtactagtaggtacgtaacgtccggtaggaaacgggtcccgtaattaccaacctactaccgtacccgaagaaacgaaccctaaaccgtaaccaaaacgtaaaacctactttccgttacttttacccaaacccgtaaaaattccggaaaacacggttaccgtaagggaacggaaacgggacccggaaggaaacccgaacggggacttaaaggggttattaaccgtttacgtaggtacggaaccggtaaggaacgacgttaccggaactaaggttaacggtaaaaccgggg

SEQ ID NO: 387166 - DNA, 596 bp, Homo sapiens
  misc_feature: GZ8MTXP02H3P1P.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtgcaattatatggtatgatggaaagtaaataaagactatgtggactccgtgaagggccattcaccatctaccagagacaactccaaagaacactctgttctaccaaatgaacagcctgagaggcgagacacggcagtgtatactgtgacgagagatacgacagtgacgtaaacgggaaagttcttttaggattcgtcggtaggggaccgaaaggggactacgtggttacctaccggtcttaccgttcacggacccttacccgaacccgaaacggggcccctaacgttcccggttcccctttccccccggtcggtcccgtccccgtcggcccgttacccggaacggaccccg

SEQ ID NO: 387167 - DNA, 613 bp, Homo sapiens
  misc_feature: GZ8MTXP02G1VT8.22.86.H09.1.454.CMB.2.raw
  modified_base (242)..(242): a, c, t, g, unknown or other
  modified_base (303)..(303): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaggggctggagtggngcaattatatgtatgatggaaataataaagatatgtaggactcgtgaaggcgatcacatcncagagacaactccaaagaacactctacgtttacaccaaatacgaacacgcctggacgagggcgaaggtaccgacggacaaggttagtaattaacgtgtggacgagaagtacacggacaagtagaacgtaaacggggtaaagttcttttagacttcctacgggtacggggaacccgaaaggggtaccaacgtcgggtacctaccgttcgtacttcacggcccttacccgaaccgaaaccgggcccctacgttcccgggtcccctttcccccggcggcccccgtaccgtcgtccgtacccgaacggggcccg

SEQ ID NO: 387168 - DNA, 606 bp, Homo sapiens
  misc_feature: GZ8MTXP02FO1O5.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcacgtggcctcccgccgaggcctcccggggcgaagggggtctggggaggtggggtggacctaagttagtagttggtatgagtaggaaagtaaagtaaaagcttaagtggtacggacgtccggtaggaaacgggccgtatcacctatcctccgaagacgaacaactaccaaagaacctactacttcgtttacctaacaaactacgaaacacgtacccgtagaaggacgggacggaacggaaccgacgggacgtaaacggttagtaacgttacgtggtacgaacggtaagaagacgtaccgaacagttacgtaaaccgg

SEQ ID NO: 387169 - DNA, 592 bp, Homo sapiens
  misc_feature: GZ8MTXP02H8DHL.22.86.H09.1.454.CMB.2.raw
  modified_base (228)..(228): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggctccgccaggctccgggnagggctggtgtgggtgcaattatatggtatgataggaaagtaataaagactatgtggactcgtgaacggccgattcaccatctaccagagaacaactaccaaagaaccacttctacgtttctaccctaaaatcgaaacagcctgaaggaggccggaagaccgacggctagtagtattactgtcgacggaagtagatcgaacatgaacgtaacgggaaattcttttaggattcgtgtacgggggtaccgaaaggggtaccaacgtcggtccgaaccgttctcttcacggccctaccaacccgtaacgggcccacgttccggtcccttccccgtcggccctccccgtgcccgttaccaacgggccg

SEQ ID NO: 387170 - DNA, 566 bp, Homo sapiens
  misc_feature: GZ8MTXP02F3GDH.22.86.H09.1.454.CMB.2.raw
  modified_base (257)..(257): a, c, t, g, unknown or other
  modified_base (334)..(334): a, c, t, g, unknown or other
  modified_base (406)..(406): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggcgtccgggcaaggggctgggagtgggtgactaattanatggtatgatggaaagtaataaagactatgtggactcgtgaaggcatcacatctcgagagacaactaccaaagaacnctctcgtttaccacaaatcgaacacgcctggagaggcgacgggacaacggcagttagtaattacgtgtacgngtaagacgatcgacagtacgacgtaacgggaaattcgtttgacttcgtcgggtagggacccgaagggctacgtggcctaccgtctcttcacggtccctacgaccgaacgggcctacgtccgttccctccccgtggaccctccgtgaccctcggacgaccg

SEQ ID NO: 387171 - DNA, 572 bp, Homo sapiens
  misc_feature: GZ8MTXP02HCWNW.22.86.H09.1.454.CMB.2.raw
  modified_base (345)..(345): a, c, t, g, unknown or other
  modified_base (373)..(373): a, c, t, g, unknown or other
  modified_base (380)..(380): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctggagtgggtggcaattatatggtatgataggaagtaaataaagactatgtggactcgtgaggccgatcaccatctcagagacaactcaaagacactctgttcacaaatnaacagctgagaggcgagacacggcagtntattacngtgacgagagatacgactatagaacgtaaacggggaaattcgttttagaacttcgtacgggtacggggaacccgaaagggacctacgtaggtccctaccgttctccttacacgtcccctaccgaaccgaacgggtccccagttccccgggttccctcccccgtggcccgtccctcgccgtaccgacgggacc

SEQ ID NO: 387172 - DNA, 715 bp, Homo sapiens
  misc_feature: GZ8MTXP02GIMQN.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcggtggtccagccgtgggacggtccctgagactctcctgtgcagcgtctggacttcaccttcaggtggctatggcatgccacgtggcctcccgccgacgggccgtcccggggacgaagggggcctaggggagggtggggtcgggaccctaaagtttagttagttagggttagttaggaagttaggggtaaaagttaaaagttaaaacggacgtttaaagtgggttacgggtaaacccgttcccggttaggggaaaaccgggggtcccgtaaacgtttaccgaaccctactacccgttacccgaacggaacgaaaccaaaccttacccgaaaacgaaacctaccttactttacgtttaccctaaccctaaaacgttacgaaacgacgtacccgaggaaacggacgggacggaaacggaccgaacgggacgtaacggttacgttaacgtttacgtggttaggaacgtaaggacgtacgtacgaacgtaagtacggtaaacgg

SEQ ID NO: 387173 - DNA, 665 bp, Homo sapiens
  misc_feature: GZ8MTXP02IBVB5.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggagcgtggtccagccgtgggagtccctgagctctcctgtgcagcgtctggacttcaccttcgagtggctagtggcatgctacgtggcctcccgcgaggccgtccggggacgaaggggctggggaggtggggtgactaaagttagtagttgggtattggaagttagggtaaaagttaaagtaaaacgacttagtaggtacggaacgttccgggtaagggaacggggtaccgtaattaccaaccgtactcctaccgaggtaacaacccaaacctaaccgaaacgtaacctaaccttcgtttaaccgttacctaaccgtaaaattaccgaaacgtacggtaccctaaggaacgggacggaccggtaaacggaacgacgggacgttaaggtacgttaacgttacgtacggtacggacggaacggaagtacgtaaacgg

SEQ ID NO: 387174 - DNA, 548 bp, Homo sapiens
  misc_feature: GZ8MTXP02FK7XQ.22.86.H09.1.454.CMB.2.raw
  modified_base (349)..(349): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactaatgtggactccggtgaaggccgattcaccatctccagagacaactccaaagacactctcgtttaccnccaaatgaacagcctgagagcgagacacggcagtgtattactgtgcgagagatcgacagtagacgtacgggaagtctttagatctcgtggggaccaagggacacgtcggactaccgtctcttccacgtcctacccaccgaacgggcccacgtcccggtcccttcccccggtggcccgccctcgtccgaccgacggaccg

SEQ ID NO: 387175 - DNA, 777 bp, Homo sapiens
  misc_feature: GZ8MTXP02F0TMC.22.86.H09.1.454.CMB.2.raw
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggacgtccctgagactctcctgtgcagcgtctggacttcaccttcaggtggctagtggcatgcacgtggcctcccggccgagggccgtcccggggacgaagggggtctaggggaggttcggggtaggaccctaaagtttagtagttagggttataggaagttagggggaaaattaaaaacgttaaaaggtacttaagtacgggtacgggtaacccgttacccggggtagggtaaaccgggggtcccgttaaacgtttcccgaaacccgtaacttccccgttaacccgaaacggaaaccgaaaacctaaacccgttaaaccgaaaacggtaaacccttaacccgtttaccttttacggttttaacccctaaaccctaaaaagttaccggtaaaaccacggttaacccgtaagggaacggaaacgggggacggaaaacgggaccgaaccgggtaccgttaaaggttaggtttaaccgtttaaccgtggttaaccggaacggtaaaggaacgtacggttaccgaaacgtaacgtacgggtaaaacccggg

SEQ ID NO: 387176 - DNA, 641 bp, Homo sapiens
  misc_feature: GZ8MTXP02I1X7P.22.86.H09.1.454.CMB.2.raw
  modified_base (540)..(540): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcacgtggccctcccgccgaggggccgttcccggggacgaacgggggccttggggacggtggggtcggaccctaaagtttagtagtggtatggtaataggggtaaataaaagtaaaagacttagtaggtagggtaccttaccggtagggtaaacgggtcccgaatttacccgaacctagtcctaccgaagaacgaaccaactacccaaagtaacctaacttcttacggtttaccaaccctaaaatcgaaacncgtaccgtggaaggacgggacggaaacggaccgaacgggacgtaaagttgttaaactacggtggtagaacgagaagactacgactagtacggtaaaaccgg

SEQ ID NO: 387177 - DNA, 684 bp, Homo sapiens
  misc_feature: GZ8MTXP02FOCUD.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtctggacttcaccttcagtggctatggacagtgcacgtggcctcccgccgagggccgtcccggggacgaaagggggtcctaggggacggtgggggtacgacccgttaaagtttagtagtggggttaatggtaagttaggggtaaaattaaaagtaaaaggtaccttagttaggtacgggtaacccgttaccgggtaggaaaccggggtcccgtaactttacccaaccctaacgtcccttaccgaagaacgaaaccctaaccgtaacccaaacgaaacctaccttactttacgtttaccaaacctaaacgtacgaaacgacgtacgagaacggacgggacggaacggaccgaacggacgtaggttacgttaagttacgtaggtacgaacggtaacggaagtacgtacgaagacgttacggtaaaccgg

SEQ ID NO: 387178 - DNA, 666 bp, Homo sapiens
  misc_feature: GZ8MTXP02F9CF4.22.86.H09.1.454.CMB.2.raw
  modified_base (257)..(257): a, c, t, g, unknown or other
  modified_base (270)..(270): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccacagccacccaggccaaacgcccccanactcatctattangctgtacaatacgccggccctgacgggtccctgactcgtcttctctcggcctacaagtctcggaccaacccgaccggtcctccctacgacctacttccgtcgtcgggacctccgaggtccgtagaacgacgtaggacggtctagtaactttacgttaccgtggtccttaggtcttacgtagtttcggacgtacgggtccctaccgttacgttacggttgggggttaccgtaccggggacgggggaaacggacccgaacggtccgtaaccgggtacccgttaccgtaacgggtccgaaaccggcccggtaacggtcccgtcccggtaccccccggttggttccctaaccggttccctcccgggtttcccccacccctccgtaccgtccggtttaccg

SEQ ID NO: 387179 - DNA, 579 bp, Homo sapiens
  misc_feature: GZ8MTXP02IM2ZD.22.86.H09.1.454.CMB.2.raw
  modified_base (226)..(226): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctggagtgggtggcaattatatggtatgatggaaagtaataaagactatgtggactccgtagaaggccgatcaccatctcagagacaactccaaagaacactctgttactaccaaatgaacagcctgagaggcgaggacacggcagtgtatacgtgtgcgagagatacgacatgaacgtaacgggaaatcgttttagattcgtcggtacggggaccgaaagggacctacgtacggttccgaccggttctccgttcgacgtccctacccgaaccgaacgggcccctaacgttcccgttcccgttcccccgtcggccccgtccccgtcggcccttccgaacgggacccg

SEQ ID NO: 387180 - DNA, 595 bp, Homo sapiens
  misc_feature: GZ8MTXP02HL6EE.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggaggtgggtggcaattatatggtatgatggaaagtaataaagactatgtggactccgtgaagggccgattcaccatctccagagacaactccaaagaacactctcgtttccaccaaatcgaacagcctgagaggcgagacacggcagtgtatacgtgtgcgagagatcgaacagtagaacgtaaacggggaaattcgttttagaacttcgtcggtagggggaccgaaaggggtaccaacgtcggtacctaccgtccttccgttcaacgtcccctaccgaacccgaaccggggtccccaacgttcccgggtcccctttcccccgtggccccgtccccgttcgccctcccgacggtacccg

SEQ ID NO: 387181 - DNA, 563 bp, Homo sapiens
  misc_feature: GZ8MTXP02IGWOD.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctggagtgggtggcaattatatggtatgatggaagtaataaagactatgtggactccgtgaggcgattcacatctcagagacaactccaaagacactctcgttcaccaaatgaacagctgagaggcgagacacggcagtgtattactgtgcgagagactcgacagtagacgtaaacggggaaagtcgttttagatcgtcgtaggggaccaaggggacacgtcggtcctaccgtctccgttacaccgtccctacccgaaacccgacgggtacccctacgttcccggttacccttcccccgcggtccgcccctcgcctaccgacgggaccg

SEQ ID NO: 387182 - DNA, 585 bp, Homo sapiens
  misc_feature: GZ8MTXP02FJLIR.22.86.H09.1.454.CMB.2.raw
  modified_base (253)..(253): a, c, t, g, unknown or other
  modified_base (358)..(358): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattnatggtatgatggaagtaataaagactatgtgactccgtgaagggccattcacatctccagagacaactcaaagacactctgtttcaccaaatgaacagcctgagngggacgagactacgggcagtagtattacgtgtgcgaagagatcgacattagacgtaacgggaaagtcttttgattcgtacggtggggacccgaaggggactacgttacggtccaccgttctcgttacacgtccctaccgaacgaaaccggggccctaacgtcccggttcccgttaacccccgtcgggtacccgtccccgtccgtccgttacccggaacggtacccgg

SEQ ID NO: 387183 - DNA, 560 bp, Homo sapiens
  misc_feature: GZ8MTXP02FS52J.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaaagtaataaagactatgtggactccgtgaaggccgattcacatctccagagacaactccaaagaacactctcgtttcctccaaaatcgaacagcctgagaggcgaggacacggcagtgtattactgtgcgagagatcgacatagactacgggaaagtctttagatctcgtacggggaccaaaggggacacgtggtcctaccgtctcttcacggtccctaccgaccgaaacgggcccctaacgtcccgggtcccttcccccgtggcccgtccccgtcggcctacccgagggacccg

SEQ ID NO: 387184 - DNA, 599 bp, Homo sapiens
  misc_feature: GZ8MTXP02FRKV3.22.86.H09.1.454.CMB.2.raw
  modified_base (250)..(250): a, c, t, g, unknown or other
  modified_base (270)..(270): a, c, t, g, unknown or other
  modified_base (310)..(310): a, c, t, g, unknown or other
  modified_base (413)..(413): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctggagtgggtgcaattnatggtatgatggaaagtaanaagctatgtgactcgtgaaggccgtatcacatctccaganacaactcaaagactactctcgtttaccaccaaatcgaacagcctggagacggacgaggaacacggtagagtagttacttattggcgacggagagactacgaanagtagtaacgtaaagggtaacttgtttagacgtcgtacgggtacgggaccgtaaggactacgtcgtacctaccgtctactaccgaccgtacccgtaccgaaccggtaccggtacccgtaccgttccccggttaccccgttccccggtacggtccccgtcccgtccgtaccgtaccgaccggtaccg

SEQ ID NO: 387185 - DNA, 611 bp, Homo sapiens
  misc_feature: GZ8MTXP02JZHN8.22.86.H09.1.454.CMB.2.raw
  modified_base (227)..(227): a, c, t, g, unknown or other
  modified_base (392)..(392): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggctaattatatggtatgatggaaagtaataaagactatgtggactccgtgaaggccgtatcacatctcagagacaactccaaagaacactctcgtttcaccaaatgaacagcctgagaggcgaggacacggacagtgtaattacgngtgacgagagatcgactagtacgaacgtaacgggtaaatcgttttagacttcgtcgggtacggggacctaaacgggggactacggtcggtccgtaaccgttcctaccttacgaccgtaccccttcccgaaacccggacgggtacccctaacgttccccggttaccccttcccccggtcggtcccccgcccgttcgacccgttacccggacggtaacccg

SEQ ID NO: 387186 - DNA, 666 bp, Homo sapiens
  misc_feature: GZ8MTXP02HGC8V.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcaccttcaggtggctagtggcatgcacgtggcctccgccaggccgtcccgggcgaaggggctggggaggtggggtgacctaaagttagtagtgggtataggagtaggggtaaaagttaaaataaacggacttaagtggtacgggaccgttcccgggtaggaacggggccctagttaccacctatcctaccgaagaacgaaccaaacctaaccgaaacgtaaaccctacccgtttactttacggttttaaccctaaccctaaaagttacggaaaacccacggtcccgtaaggaacgggaacggggaccggtaaacgggaaccgacgggtaccgtaggttacggttaacttaaccgtaggtcggaacgaaggaagtactaccggaactacgtaggtaaacccgg

SEQ ID NO: 387187 - DNA, 546 bp, Homo sapiens
  misc_feature: GZ8MTXP02FNVYM.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggtccagccgtggggacggtccctgagactctcctgtgcagcgtctggattcaccttcagtgctatggcatgcacgtggcctccgccaggccgtcccggggacgaagggggctggggagtggggtgacctaagttatagtggtatggaatgggaaagtaaataaagactagtgtaggactccgtaggaacggcgagttcacctatcctaccagagaacaactacaagaaacactactcgtttacaccaaatagaacagctagagaggacgaggacgacggcgtagtattactacgtgtgaagagacgactacgacagtacgtaaacgg

SEQ ID NO: 387188 - DNA, 627 bp, Homo sapiens
  misc_feature: GZ8MTXP02ID4RH.22.86.H09.1.454.CMB.2.raw
  modified_base (188)..(188): a, c, t, g, unknown or other
  modified_base (225)..(225): a, c, t, g, unknown or other
  modified_base (428)..(428): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtgctatggcatgcactggctccgcaggctccgggnagggctggagtgggtgcaattatagtggtatgataggaagtaataaagactagtggtaggtacctccggtaggaacggggccgtaatttccaacccgatcctaccgaagtacgaaccaaactaccaaagtaaccacctcttaccgtttacctacccaaatcgaaacacgcctaggagacggcgaaggtaccacgggacaggtntatacgtgagcgaagagatcgacagtacgaacgtaacggggaaattcgttttgaattccgtacggtaggggaccgaaaggggtacctaggttcggtcctaaccggtctacttacgacgtccctaccgaaaccggaacgggtccccacgtttcccggtcccttcccccgcggccgtccccctggtccctacgaacgggcc

SEQ ID NO: 387189 - DNA, 744 bp, Homo sapiens
  misc_feature: GZ8MTXP02H0K2Y.22.86.H09.1.454.CMB.2.raw
  modified_base (189)..(189): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctagattcaccttnagtgctatggcatgcactggctccgccaggcctccgggcgaaggggctgggagtgggtggactaattatagtggtatgataggaaataaataaagactagtgtaggactccggtaggaaacgggccgtattccaccatcctaccgaagacgaacaactaccaaaagaacctactcttacgtttaccaacctaaaagtacgaaacacggtccctaggaaacgggaacgggaccggaaagggtaacccgaaccggggactaagggttacttaagtttacgttaggtacggacggaaaggagtaacgtaccggaaactaagttacggaaaaccggtaaacggggtaaaagttcgtttttaagacgttaccgtacgggtaccggggaaccgaaagggggaaccctacggttaccgggtaccctaacccggttccttaccttacccgaccggtccctaacccgaaacccggaaaccgggtacccctaaccggttccccgtttcccccgttcccccgtcgggcccccgtacccccgtcgtacccgtacccgaaggaccccg

SEQ ID NO: 387190 - DNA, 567 bp, Homo sapiens
  misc_feature: GZ8MTXP02GKTZ4.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggctccgccaggctccgggcaaggggctggagtgggtggcaattatatggtatgatggaaagtaataaagactatgtggactccgtgaaggccgattcaccatctccagagacaactccaaagacactctcgtttcaccaaatgaacagcctgagaggcgagacgacggcagtgtattactgtgcgaagtagacgtcgaactagtacgaacgtaacgggaaagtccttttagattcctacggtcggggacccaaaggggactacgtacgggtccaccgtctccgttcacggcccttaccaaccgacggccctacgtcccgttcctcccccgtggcccgtccgtcgcctccgacggaccg

SEQ ID NO: 387191 - DNA, 554 bp, Homo sapiens
  misc_feature: GZ8MTXP02ISSPL.22.86.H09.1.454.CMB.2.raw
  modified_base (226)..(226): a, c, t, g, unknown or other
  modified_base (536)..(536): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctggagtgggtggcaattatatggtatgatggaaagtaaataaagactaatgtggactccgtagaaggccgatcacatctcagagacaactaccaaagaacactcttcgttaccacaaatgaacacgcctgagaggcgaggacacggcagtgtatactgtgcgagagatcgacatgaactaagggaaatctttagatcgtacgtaggggaccaaggggacacgtcggtcaccgtctccgttcacgccctaccgaaccgaacgggtcccacgttcccggttcccttcccccgtcggcccgtcccncggtcctaccgacggccg

SEQ ID NO: 387192 - DNA, 583 bp, Homo sapiens
  misc_feature: GZ8MTXP02JYVF1.22.86.H09.1.454.CMB.2.raw
  modified_base (250)..(250): a, c, t, g, unknown or other
  modified_base (258)..(258): a, c, t, g, unknown or other
  modified_base (269)..(269): a, c, t, g, unknown or other
  modified_base (384)..(384): a, c, t, g, unknown or other
  modified_base (447)..(447): a, c, t, g, unknown or other
  modified_base (453)..(453): a, c, t, g, unknown or other
  modified_base (479)..(479): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctcctgngcagcgtntgattcacttnagtgctatggctatcgcactggcctcccgccgaggcctccgaggcgaaggggctaggggaggttgggtctactaagttataggttgtatagagtaggaaacgttaaagtaaacgntaagtgtgaccgtcggtaaggacgggctacttaccgactatccacgagacaactacacgaaanactctnttacgtttacacctaaagtcgaaacncgaccgtaggaagacggtaccgaggtaccgacggtactacggttagtaacctttcggagtaaccgggacgaaacgggactagtaccggaaactagtaaacgggg

SEQ ID NO: 387193 - DNA, 735 bp, Homo sapiens
  misc_feature: GZ8MTXP02HSXDR.22.86.H09.1.454.CMB.2.raw
  modified_base (262)..(262): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagctttcnggattcaccttcagtggctatggcatgcacgtggcctcccggccgacggccgtccggggcgaagggggtcgtaggggacgggtggggtggacctaagttagtagtggttatggataggggtaaattaaataaagtacttaagtggtaggaccgtccggtaggaaacggggcccgtaattaccgaaccctacttcccgtacccaagggaacaaaccctaaaacctaacccgaaaacgtaaacccttaaccgtttaccttacgtttttaccctaaccccgttaaatttaccggaaaacctacggtacccgttaagggaccgggtaaacggggacccgggaaacggggtaacccggaacccgggggtactaaacggggttttacggttaaactttaaccgggttggttaggaaccgggtaaggaaaccggtttacgtaaccgggaacctaaacggtttaacgggtaaaacccgggg

SEQ ID NO: 387194 - DNA, 560 bp, Homo sapiens
  misc_feature: GZ8MTXP02H5KJL.22.86.H09.1.454.CMB.2.raw
  modified_base (539)..(539): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaaattatatggtatgatggaaagtaaataaagactatgtgactccgtggaaggccgattcaccatctccagagacaactaccaaagaacactctcgtttctaccaaatgaacagcctgagaggacgagacgacggctagtgtatactgtgacgagagatgacatagacgtaacggaaagttctttgatacgtcggtggggaccgaagggactacgtggtaccgaccgtcttaccttcacgtccctacccaacgaaccgggtcccacgttccggtcccttcccccgtggcccncccgtgcctaccgacggaccg

SEQ ID NO: 387195 - DNA, 559 bp, Homo sapiens
  misc_feature: GZ8MTXP02FFGVK.22.86.H09.1.454.CMB.2.raw
  modified_base (284)..(284): a, c, t, g, unknown or other
  modified_base (406)..(406): a, c, t, g, unknown or other
  modified_base (418)..(418): a, c, t, g, unknown or other
  modified_base (534)..(534): a, c, t, g, unknown or other
  modified_base (538)..(538): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccggccgggctccgggcaagggggctgggagtggggtgctaattatatggtatgatggaataataaagactangtgactccgtgaagggccattcaccatctccagacgacaaacctccaaaagaaccactcttagtttccccaccgaaaatgaaacagccctggagaggcgaggactacggcagtgtattacgngtgacgagagancgacatgaacgtacgggaaatctttagatcgtgtacggggaccaagggacacgtggtccaccgtctcgtcacgtccctccgaaccgaacgggcccacgtcccggtccttcccccgngccnccctcgcctccgacggcaccc

SEQ ID NO: 387196 - DNA, 537 bp, Homo sapiens
  misc_feature: GZ8MTXP02JP2SF.22.86.H09.1.454.CMB.2.raw
  modified_base (399)..(399): a, c, t, g, unknown or other
  modified_base (476)..(476): a, c, t, g, unknown or other
  modified_base (512)..(512): a, c, t, g, unknown or other
  modified_base (518)..(518): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgataggaaagtaaataaagactatgtaggactccgtaggaaggcgatcacatctcagagacaactcaaagacactctcgttcaccaaatagaacagctgagaggcgaggacacggcagtctattctgtgacgagagancgacagtagaacgtaaagggaagttcttagactcgtcggtgggaccaagggacacgtggtcctacgtctcttacgcnccctaccaccgacggcctacgtccggtcctccccgnggcccncctcggcctacgacgaccg

SEQ ID NO: 387197 - DNA, 631 bp, Homo sapiens
  misc_feature: GZ8MTXP02HFPN0.22.86.H09.1.454.CMB.2.raw
  modified_base (358)..(358): a, c, t, g, unknown or other
  modified_base (364)..(364): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcgtggtttcgcgttagctctttaagaggtgtccagtgtcaggtgcagctggtggagtcgtgggggagcgtggtccaggcctggggaggtccctgagacttctcctgtgcagcgtctggattcaccttcagtggctagtggcatgcactgctcccgcaggcctccggggcaaggggctaggggagtggggtcggnaaattntagtggtatggatagggaaataagtaaaagattagtgttaggacttaccgggaggaaacggggcctacgttcgaaacccgtactaccgtacgaaagaacgaaacctaaaccgtaaccgaaacgtaacctacttaccgttacgtttacctaacgtaaactacgaaacgtacgtacgtaacggacggacggaacggaacgtaaccggacggtacgtaaggttacgttaacgttacgtacggtacggtacggacggtaacgtaacgtacg

SEQ ID NO: 387198 - DNA, 587 bp, Homo sapiens
  misc_feature: GZ8MTXP02J5E2D.22.86.H09.1.454.CMB.2.raw
  modified_base (200)..(200): a, c, t, g, unknown or other
  modified_base (219)..(219): a, c, t, g, unknown or other
  modified_base (224)..(224): a, c, t, g, unknown or other
  modified_base (343)..(343): a, c, t, g, unknown or other
  modified_base (360)..(360): a, c, t, g, unknown or other
  modified_base (579)..(579): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccngcagtgatgttggtgttanaactntgtctcctgtaccaacagcaacccaggcaaacgcccctagactcatctattatgctagtcaataacgccggccctcaggggtccctgatcgcttctctcggctaccagtctggccaacncggcctcctccgtaccnctctcgtcggtcgtccacgagtacgtagagtgtcggtgtagttattattacttcgtcgtacgtctactagttacgtcgtcgccggtccgtaccgtacgttcgggttacgggttcgggtcggggtacggggacgtacgacgtcgtaccgtacgtccgtacgaccgtaccgaccgtaccgcccgtcccgtcccgtccgtctccgtcctcccgttaaccccncccgttcc

SEQ ID NO: 387199 - DNA, 587 bp, Homo sapiens
  misc_feature: GZ8MTXP02HZKXA.22.86.H09.1.454.CMB.2.raw
  modified_base (226)..(226): a, c, t, g, unknown or other
  modified_base (311)..(311): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggctccgcaggctcgggnaagggctggagtgggtgctaattatatggtatgatggaaagtaataaagactatgtgactccgtgaaggccatcacatctcaganacaactccaaagaaccacttcttacgtttactaccaaatcgaaacagcctggagaggcgagaacgacggctagtgtatacgtgtgcgagagactagaacagtcgaacgtaaagggaaattcgttttagaattcgtggtacggggaccaaaggggacctacgtggtacctaaccgtcttcctttacgacggtccctacccaaaccggaaacggcccctaacgttcccgggttcccttcccccgtggtcccgccccgtacgcccttccgaacggtccg

SEQ ID NO: 387200 - DNA, 597 bp, Homo sapiens
  misc_feature: GZ8MTXP02G8N3U.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggagtccctgagactctcctgtgcagcgtctggattcaccttcagtggctatggcatgcacgtggcctccgccaggctccggggcgaaggggctgggaggtggggtggacctaattatagtggtatgaagtaggaaagtaaataaaaggactaagtggtacggaccgtcccgtaggaaacggggccctaattccaacctatcctacccaagacgaaccaaactaccaaaagaaacctacttctagtttacctaaccaaaatcgaaacctagccctaggaaggacggacggaacggaccgacgggacaaggttacgtaattacgtggtacgaacggaagagtactacggaactagttacggaaaaccgg

SEQ ID NO: 387201 - DNA, 675 bp, Homo sapiens
  misc_feature: GZ8MTXP02JOG80.22.86.H09.1.454.CMB.2.raw
  modified_base (131)..(131): a, c, t, g, unknown or other
tcagacatacgcgtcacgaccggtgctcgatttagtgctatagacgttgggtttgggctgagctgggttttcctcgttgctcttttaagaggtgtccagtgtcaggtgcagctggtggagtctgggggaancgtggtccagcctgggagtccctgagactctcctgtgcagcgtctggattcaccttgagtggctagtggcatgcacgtggctccgcgaggccgtccgggagaaggggctgggaggtgggtgactaattagtagtggtataggagtaggtaaataaacaagtatagtggtggactccggtaggaacggctacgtcactatcacaagacgactaactacgaaagtacctactcttaccgtttaccaacgtaaaactacgaacgacgtccgtagggacggaacgggaccggaaacgacgtacgggataggttagttacgtacgtggagaacgagaatacgtaccgaaatgtacgtaaacggtaaagggtaatttcgtttacgattccggttggggaaccggggaaccgtaaaaggggaccttcggttcggtaccgtaaccgttctacgttaccggacctaccccgtaccgaaaccggtaaccggtccgtacggttccccgtaccttcccggtcggccctacccgtgacccgttacggacgtaacccg

SEQ ID NO: 387202 - DNA, 592 bp, Homo sapiens
  misc_feature: GZ8MTXP02GK5UQ.22.86.H09.1.454.CMB.2.raw
  modified_base (293)..(293): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttnagtggctatggcatgcactggcctccgccaggcctccggggcaagggggctggggagtggggtggactaagttatagtgggtaatggagtagggaaagtaaataaagacttagtgtaggacgtcggtaggaaggggccgattacgacctagtcctaccagaacgaaccaaacctaccaaagaacctacttacttacgtttacctaacctaaaatcgaaaactacgtaccctaggaacggacgggaccggaaggaaccgacggacagttagtaattacgtgtacgacgagagacgtaccg

SEQ ID NO: 387203 - DNA, 592 bp, Homo sapiens
  misc_feature: GZ8MTXP02IKKJ5.22.86.H09.1.454.CMB.2.raw
  modified_base (238)..(238): a, c, t, g, unknown or other
  modified_base (368)..(368): a, c, t, g, unknown or other
  modified_base (402)..(402): a, c, t, g, unknown or other
  modified_base (557)..(557): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtacaangcaccaggcaacgccccagactcatcatttatgctgtacaataacgccggtccctcgacggggtccctgactcgcttctcgtggcctccaagtcctcggaccaaccgaccggccctcccgtacgaccctnttcctcgtcgggaccctcccgaggcctagaaagntcggagctagtatttatactgctgtctctagtttgacgacggcctcgtacgtacggtttcgggtcggttcgggcgggtaacggaccgtaagcgtacgtaccgttcgtacgggtccaacggacccaacgggtccctccggcccccttcggtacccnccttccgtcccgttaccccctacccctcgtacccg

SEQ ID NO: 387204 - DNA, 647 bp, Homo sapiens
  misc_feature: GZ8MTXP02HK0N9.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgacgactctcctgtgcagcgtctggattcaccttcagtggctagtgcatgcactggcctccgccgaggcgtccgggcgaaggggctgggaggtggggtggacctaagttatagtggtatggagtgggaaagttaaataaagtactagtggtacggtaccgtaccggtaggaaacgggccgtaattcccgaaccctacttacctaccgaacggtaacgaaaccctaaacctaacccgaaaacggtaaacctaactttacgttacgtttaccctaacctaaaagttacgaaacgtacggtaccctagggaacggacgggccgggaaacggaccgaccgggactaggttagtacgttaccgttaggtacggtaacggaaggaacgacgtacgacgtaagtacgtaaaccgggg

SEQ ID NO: 387205 - DNA, 560 bp, Homo sapiens
  misc_feature: GZ8MTXP02J30K8.22.86.H09.1.454.CMB.2.raw
  modified_base (188)..(188): a, c, t, g, unknown or other
  modified_base (371)..(371): a, c, t, g, unknown or other
  modified_base (401)..(401): a, c, t, g, unknown or other
  modified_base (408)..(408): a, c, t, g, unknown or other
  modified_base (425)..(425): a, c, t, g, unknown or other
  modified_base (538)..(538): a, c, t, g, unknown or other
  modified_base (543)..(543): a, c, t, g, unknown or other
  modified_base (547)..(547): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtgctatggcatgcactggctccgccaggcgtccgggcaaggggctgggagtgggtgactaattatatggtatgataggaaactaaataaagctatgtggacctccggtgaacgggcctattccaccatctaccagacaccaactccaaagaacctactcttgttacctaccaaatcgaacncgcctggagacggtcgagacgcggatagtntattacngtacgcgagagatcganagtagacgtagggaaatcgttttgacttcgtcggtcgggaccgaagggacacgtcggtctaccgtctcttcacgccctaccgaccgacggcccagtcccggtcccttccccgnggccncctncctcgacggaccg

SEQ ID NO: 387206 - DNA, 723 bp, Homo sapiens
  misc_feature: GZ8MTXP02IAVGU.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtcagccgtgggagtcctgagctctcctgtgcagcgtctggtattccaccttcgagtggctagtcgggcagtcgcacgtcggcctcccggccgaggccgtccggggacgaacggggtctggggaggtggggtggactaagtttagtagtggtagtagagttagggtaaagttaaagtaaaagtacttaagtaggtaggtaccgttccggtagggaaaccggggtaccgtaattaccaacccgtacttccgtaccgaaaggtaaccaaaccctaaaaccgttacccgaaaacggtaaccctaccgtttaccgttacgtttaccctaaacccgtaaaagttaaccgaaaccgtaacggtacccgttaggaaacgggaccggggaaccggaaaccggggaacccgaacggggtaccgttaaaggtttacggttaaaccgtttacggtaggttacgggaccggtaaacgggaaggttaacgtaacccggg

SEQ ID NO: 387207 - DNA, 566 bp, Homo sapiens
  misc_feature: GZ8MTXP02HWSRD.22.86.H09.1.454.CMB.2.raw
  modified_base (275)..(275): a, c, t, g, unknown or other
  modified_base (322)..(322): a, c, t, g, unknown or other
  modified_base (388)..(388): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgataggaaagtaaanaaagactatgtggactcgtgaaggccgatcacatctcagagacaacncaaagaacactctcgtttcaccaaatagaacagctgacgaggcgagacacggacagtgtattacgngtgcgagagatcgacagtagaacgtaacggggaaattcttttagacttacgtcggtacgggggaccgaaagggggacacgttcggtaccacgttctcgttcaacgtccctaccgaccgaaacgggccctacgtcccggtccctttcccccgcgccgtcccctcgacctccgaggaccg

SEQ ID NO: 387208 - DNA, 560 bp, Homo sapiens
  misc_feature: GZ8MTXP02GPEHZ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggggtggagtcgtgggggaggcgtggtccagccgtgggagtccctgagactctctgtgcagcgtctggattccaccttcagtggctatggcatgcacgtggcctccgccgaggcctcccggggacgaacggggctggggacgtggggtggaccctaagttatagtggtatggaatgggaaataaagtaaagactagtggtaggactcgtaggaaacgggtccgattcaccgtatcctcagaacacaaactaccaaagaacctcgttctagtttacaccaaatgaacagcctagagtcggacgaggaccgaggctagtagtacgttactggtcgaagagtacgacgtacgactagtacgtaaacgg

SEQ ID NO: 387209 - DNA, 664 bp, Homo sapiens
  misc_feature: GZ8MTXP02JHR2I.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggaggcgtggtccagccgtgggagtccctgagctctcctgtgcagcgtctggacttcaccttcagtggctatggcatgcacgtcggcctcccggccgacgggccgtccggggacgaacgggggtctacggggaggttggggtggacctaaagtttagtagttggggtaatggaagttaggggaaaattaaacgtaaaagacttagtaggttaggacgttaccggtaggaacggggaccgtacttccgaaccgtatccgtaccgagacgaacaacccgtacaaacgtaacctacttaccttacgtttaccaacctaaagtacgaaaccgtacgaccgtaggaacggacggaccggaaacgggaccgaacccgggtacgaaggtttacggttaaaacgttacgttcgggtacggaacggacggaagtaacgtacgg

SEQ ID NO: 387210 - DNA, 594 bp, Homo sapiens
  misc_feature: GZ8MTXP02GKJOK.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcgtctggattcaccttcagtggctatggcatgcacgtggctcccgccaggccgtccgggcgaaggggctgggagtggggtgccaagttatagtggtatgagtgggaaagtaaataaagactagtggtagacgtccgtaggaacgggcctattccacctatccctaccaagaacgacaaacctaccgaaacgaactaccttcgttacgtttacctaacccaaaagtacgaaacacggtcctaggagacgggacgaacgggacgacgggactaggttacgttaacgttacgtggttagaacggaagtaacggtactacggaactacggtacggtaaaccgg

SEQ ID NO: 387211 - DNA, 587 bp, Homo sapiens
  misc_feature: GZ8MTXP02FPVZ8.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactatgtggactccggtgaagggccgattcaccatctccagagacaactcaaagaacactctgttctaccaaatgaacagcctgagaggcgaggacacggcagtgtattactgtgcgaagagatacgacagtagaacgtaaacgggaaagtcttttagattctacgtggggacctaaaggggactacgtaggtccaccggtctaccttcgacgccctaccgaaccgaaacggggcccctaacgttcccggttccccgttcccccgttcgggccccgtccccgttcggcccttacccgagggaaccccg

SEQ ID NO: 387212 - DNA, 543 bp, Homo sapiens
  misc_feature: GZ8MTXP02JRA0U.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggcaggggctgggagtggggtgcctaattagtatggtatggaatggggaaattaaataaagtactatggtggacctccgtagaacggggccgattccgaccatcctcaagagacaactacaaagaacactctgtttaccacctaaatcgaaacagccgtagagaggacgaagggaccacgggcaaggtgtaacttacgtgtcggaacgaggagacgtccgactagtacgtaaacgg

SEQ ID NO: 387213 - DNA, 594 bp, Homo sapiens
  misc_feature: GZ8MTXP02HAEG4.22.86.H09.1.454.CMB.2.raw
  modified_base (359)..(359): a, c, t, g, unknown or other
  modified_base (384)..(384): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcgtccgggcgaaggggctggagtgggtggctaattatagtggtatgatggaaagtaataaagactatgtggactccgtagaaggccgattcaccatctcagacgacaactcaaagacactctcgttcaccaaatcgaacngcctgacgaggcgagcacggcagtntattactgtagcgagagactacgacagtacgaacgtaaagggaaagttcgtttagattccgtaggtacggggaccaacgggactaacgtcggtacctaccggtctcgttacgaaccgtccctacccgaaaccgaaacggtccccaacgttcccggttacccccgttccccgtcggtcccgtcccgtacgcccgttaccgacggaaccccg

SEQ ID NO: 387214 - DNA, 553 bp, Homo sapiens
  misc_feature: GZ8MTXP02H4PH6.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgtgaaggccgattcaccatctccagagacaactccaaagaacactctcgtttactccaaatgaacagcctgagaggcgagacacggcagtgtattactgtgcgagagatcgacatgacgtaagggaaagtactttgatctacgtcggggaccaagggacacgtcggtctaccgtctacttcacgccctaccgaacctacgggccctaacgtcccggttccttccccccgtcggcccgtcccctcgccctaccgacggaccg

SEQ ID NO: 387215 - DNA, 662 bp, Homo sapiens
  misc_feature: GZ8MTXP02G89GA.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggccgtccggggcaagggggctgggaggtgggtggactaattatatggtatgataggaaagtaaataaagactatgtggactccgtggaacggccgtatcaccatctcagacgacaactaccaaagaacactctcgtttacctaccaaatcgaaacacgccgtggaagacgggacgaacggaaccgacgggctaaggttgttaatttacgtgtacggacgaagaacgactacggaactaagtagaaacgtaaacggggaaattcgttttagacgttccgttcgggtacgggggacccaaagggggacctacggtacggtaccctacccggttcttccgttaccgaccggtcccctacccgaaacccggaaccgggtcccctacgttcccggtttccccttcccccgtgggccccgtccccgtcgtccctaccggacggacccg

SEQ ID NO: 387216 - DNA, 646 bp, Homo sapiens
  misc_feature: GZ8MTXP02I27VX.22.86.H09.1.454.CMB.2.raw
  modified_base (339)..(339): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattatagtggtatgataggaaagtaaataaagactagtgtggactccggtaggaacgggccgtattcacatctacagagacaactccaaanacactctcgttacacaaatgaacagcctgagaggacgaagacgacggacagtagtattacgtgtacgacgaagagactacgaactagtacggaacgtaaacgggggtaaattccgttttagacttaccgttacgggtacggggaacccgaaaggggtacctaccggtcggtacccgtaccgtccttaccttaccgaccgtacccctacccgaaacccgtaaaccgggtccccctaacggtcccccggttaccccgttcccccgtcggacccccgtccccgtcgtaccccgtaccggacgggtacccg

SEQ ID NO: 387217 - DNA, 581 bp, Homo sapiens
  misc_feature: GZ8MTXP02JLPW3.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtggcaattatatggtatgatggaaagtaaataaagactatgtggactccggtgaaggccgtattcaccatctccagacgacaactccaaagaacactctcgttcaccaaatgaacagcctgagaggcgaggacacggcagtgtattactgtgacgtagagatcgaacagtacgacgtaaacgggaaagttctttagactcgtcggtacggggaccgtaagggacctacggtcggtaccgaccgtctcttaccgacgtccctaccgaaccgtaacggcccctaacgttcccggtacccttcccccgttcggccccgtccctcgtcctaccgacggaccg

SEQ ID NO: 387218 - DNA, 549 bp, Homo sapiens
  misc_feature: GZ8MTXP02H2E3T.22.86.H09.1.454.CMB.2.raw
  modified_base (242)..(242): a, c, t, g, unknown or other
  modified_base (363)..(363): a, c, t, g, unknown or other
  modified_base (433)..(433): a, c, t, g, unknown or other
tcagacatacgcgtcacgaccggtgctcgatttagtgctatagacttgggttttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctctggtaccaangcacccaggcaaacgccccagactcatcatttatgctgtcaataacgcggccctcgacggggtccctgactcgtcttctctggctccaagtctcggacaaccgacggccctccctgacccnttcctcgtcggggcctccgagctacgaagatgaggctggtatttattactgctgctctatttgcaggtcncctagcgttggggtgttcgggcggaacggggaccagtctcggtaccgtcgttagggcacggacccaggcctccgcccccgtggtcccacgtcctaccgtccccctacctccgtccg

SEQ ID NO: 387219 - DNA, 659 bp, Homo sapiens
  misc_feature: GZ8MTXP02IZ1NZ.22.86.H09.1.454.CMB.2.raw
  modified_base (276)..(276): a, c, t, g, unknown or other
  modified_base (549)..(549): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacgtccctgacgactctcctgtgcagcgtctggattccaccttnagtggctagtgcatcgcacgtggcctccccggccgagggcccgtcccggggacgaacgggggtcctggggtaggtggggtggtacctaaatttagtagttagggtatggaagttaggggtaaaagtaaataaaaggtctaagttgggtacgggacgttaccggtaggaaacggggtacccgtattccgaaccctatccctacgaagaacgaaccaaacctaccaaaacgtaacctacttcttacgtttacctaaacctaaagtcggaaaaccncgtaccgtaggaacggacgggacggaacgggacgacggtacgtacggttagttaacttacggtggtacgaacggaagaacgtacgtacgaacctaacggtacggtaaacg

SEQ ID NO: 387220 - DNA, 589 bp, Homo sapiens
  misc_feature: GZ8MTXP02GHX5P.22.86.H09.1.454.CMB.2.raw
  modified_base (419)..(419): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggaggtgggtgacaattatatggtatgataggaaagtaaataaagactaatggtaggactccgtggaacggccgtattcaccatctaccagagacaactaccaaagacacttctagtttccacaaaatcgaaacagcctaggagaggacgaagacacgggcagtgtaattcgtagtcgagaganatacgacatagacgttaaacggggaaattcttttagacttcgtaggtacggggaccaaaggggtctaacgtcggtacctaccgttctacgttccacggccctaccgaccgaacggcccctacgtcccgttccctccccgtggtcccgtcccctggccctccgaacggccg

SEQ ID NO: 387221 - DNA, 558 bp, Homo sapiens
  misc_feature: GZ8MTXP02F4SZ4.22.86.H09.1.454.CMB.2.raw
  modified_base (313)..(313): a, c, t, g, unknown or other
  modified_base (343)..(343): a, c, t, g, unknown or other
  modified_base (351)..(351): a, c, t, g, unknown or other
  modified_base (372)..(372): a, c, t, g, unknown or other
  modified_base (390)..(390): a, c, t, g, unknown or other
tcagacatacgcgtcacgaccggtgctcgatttagtgctatagacttgggtttgggggctttgcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaaacaacacccaggcaaagcccccaaaatcatgatttatgaggtcaactaagcggaccctcaggggtcccctgatcgcttcnctggctccaagtctggcaacacggctcccngaccgtcncctgggctccaggctgagggntgaggctgaattattacngcagctacatagtgagcgagacgataagttaggttggttcggacggacggacgaacgacgtacgtaccgtaccgtacgtacgacgaccgaacgacgtccgcccgtccgtcctactcgtccgtcccgtccctcctccgtaacgtacgtacgtcgtcgtcgacggcggcg

SEQ ID NO: 387222 - DNA, 568 bp, Homo sapiens
  misc_feature: GZ8MTXP02J0F38.22.86.H09.1.454.CMB.2.raw
  modified_base (315)..(315): a, c, t, g, unknown or other
  modified_base (516)..(516): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagactctctgtgcagcgtctggattcaccttcagtggctatggcatgcactggcctccgccaggcctccgggganaacggggctggggagtggggtggactaatttagagtggtatgagtaggaaattaacgtaagctatgtaggactcggtagaagggccctattcgaccatcctcagacgacaactaccaagaacactcttacgttccactaaatacgaaacacgcctaggacggacggacgacggacacggacgtagttgtaacgtttacggnggtacgacgagacgtaacgacgaacacggtacgaacggtaacggtacgtttg

SEQ ID NO: 387223 - DNA, 634 bp, Homo sapiens
  misc_feature: GZ8MTXP02H4G70.22.86.H09.1.454.CMB.2.raw
  modified_base (572)..(572): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggagtccctgagactctcctgtgcagcgtctggacttcaccttcagtggctagtggcatcgctacgtcggcctccgccgagggcctccggggacgaaggggctaggggagtggggtacggacctaaagtttatagtgggtataggaagttagggaaaagttaaataaaagtacttaagttcgggtaggtaccgtaccggtaggaaacggggtccctaattacccgaaccctatcccgtaccgaagaacgtacaaaccgtaccaaaagtacctactttcttacggtttacacccgtaaaatcgaaactcgaccgtaggaagacggacggacggaacgaccggtntaacggtattacgttacgtggtagaacgaagacgacgttacgaacctagttacggaaaccgg

SEQ ID NO: 387224 - DNA, 623 bp, Homo sapiens
  misc_feature: GZ8MTXP02FWK96.22.86.H09.1.454.CMB.2.raw
  modified_base (200)..(200): a, c, t, g, unknown or other
  modified_base (208)..(208): a, c, t, g, unknown or other
  modified_base (211)..(211): a, c, t, g, unknown or other
  modified_base (250)..(250): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagcgtggtttcgcgtaggcgtctttaagaggtgtcagtgtcaggtgcagctggtggngtgtgggnggngtgtcgagcgtggcggtccgtgagactctccgtgtgcgngtcgtcgtgtacttcctaccttcgtagtggtcgtagtgcgtatgcgcgtcgtccgtcccgccgacggccggtccgggacggacggggacggtggtagggtgggtaggagtaagttagtagtagtagtagtagtaggtaaagttaaagtaagtagtagtaggtacgtacgtacggtacggtaacgggtacgtacgttaccgtacctactacctacgacgaacgaacaacaaccgaaacgtaactacttacttaccgttaccttaacctaactaacgtaacgacgacgtagacggaggacggacgacgacgacgtagtagtagtagtagtgacgagagtaagtacgacgtacgtagacggtaacggtaacgttag

SEQ ID NO: 387225 - DNA, 563 bp, Homo sapiens
  misc_feature: GZ8MTXP02JW5G8.22.86.H09.1.454.CMB.2.raw
  modified_base (294)..(294): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggctaattatatggtatgatggaagtaataaagactatgtggactccgngaaggccgattcacatctcagagacaactccaaagaacactctcgtttcaccaaaatcgaacacggcctggagaggcgaggacacggcagtgtattactgtgcgagagatacgacagtagacgtaacggggaaagtctttagatcgtcgtaggggaccaaggggacacgtcggtccaccgtctcttcgacgtccctaccgaccgtaacgggccccaacgtcccggttcccttcccccgtggccccgcccgtcgcctacccgaggacccg

SEQ ID NO: 387226 - DNA, 601 bp, Homo sapiens
  misc_feature: GZ8MTXP02JOJYD.22.86.H09.1.454.CMB.2.raw
  modified_base (227)..(227): a, c, t, g, unknown or other
  modified_base (318)..(318): a, c, t, g, unknown or other
  modified_base (383)..(383): a, c, t, g, unknown or other
  modified_base (399)..(399): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggaggtgggtggcaattatagtggtatgatggaaagtaaataaagactagtgtaggactcgtaggaaggccgtatcacatcncagacacaactacaaagaacactctcttcacaaatcaacagctgagaggcgaggacacggcagtntatactgtgacgaganagtacgactagagaacgtaaacggggaaattcgtttagacttcgtacgggtacggggaaccaaaggggtacctacgttcggtacccgtacccgttcttaccttacgaccgtccccgtaacccgaaaccggaaccgggtcccctacgttccccggttccctcccccggtcggcccgtccccgtcgccctaccggacggacccg

SEQ ID NO: 387227 - DNA, 561 bp, Homo sapiens
  misc_feature: GZ8MTXP02HB3ML.22.86.H09.1.454.CMB.2.raw
  modified_base (226)..(226): a, c, t, g, unknown or other
  modified_base (391)..(391): a, c, t, g, unknown or other
  modified_base (540)..(540): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctcgggnaaggggctggagtgggtgcaattatatggtatgatggaaataaataaagactaatgtggactccgtaggaaggccgattccaaccatctacagagacaactccaaagaacactctgtttacaccaaatgaacagcctgagagcgagacacgcagtgtatacgtgngcgagagatacgaacatagaacctaaggggaaatcgttttagaatcgttcgagggggaccaaagggacaacgtggtaccaccgtctccttacaccgccctaccaccgaaacgggccccaacgtcccggttaccttcccccgtgggcccncccgtgccctacgaacggccg

SEQ ID NO: 387228 - DNA, 541 bp, Homo sapiens
  misc_feature: GZ8MTXP02FK0JJ.22.86.H09.1.454.CMB.2.raw
  modified_base (338)..(338): a, c, t, g, unknown or other
tcagacatacgcgtcacgaccggtgctcgatttagtgctatagacttgagctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctccgccaggcctccggggcaaggggctgggagtggggtgcaattanatggtatgatagggaaagtaaataaagacttaagtggtaggactccggtaggaaagggccgaattccgacccatcctaccaagacgaaccaaactacccaaagaaccacttacttacgtttaccaccctaaaatacgaacaacgcctagagacggacgaggacacggcagtagtatactgtgacgaagagatacgacagtacg

SEQ ID NO: 387229 - DNA, 582 bp, Homo sapiens
  misc_feature: GZ8MTXP02HV021.22.86.H09.1.454.CMB.2.raw
  modified_base (227)..(227): a, c, t, g, unknown or other
  modified_base (559)..(559): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggcaattatatggtatgatggaaagtaataaagactatggtggactcgtagaacggcctatcaccatctccagacacaactccaaagaacacgtctcgtttacaccaaatgaacagcctgaagacggacgaggaccacggtcagttagtattacgtagtcgacggaagagatacgaactagtaggtaaccgtaaacggggtaaaattcgttttagaacgttcgtacggtcggggacctaaaggggactacgtggtacctaccgtctcgttacacgtcccaccaacgacgggcccacgtccggtcccttccccgngcccgcctcgccaccgacgaccg

SEQ ID NO: 387230 - DNA, 702 bp, Homo sapiens
  misc_feature: GZ8MTXP02JU1XM.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccaggccgtgggacgtccctgacgactctcctgtgcagcgtctggattcaccttcagtggctagtggcatgcacgtcggcctccgccgaggccgtcccggggacgaaggggctaggggaggtggggtagacctaaagtttagtagtagggttatggaagttaggggaaaagttaaagtaaaagacttagtagggtacgggtaccgttaccgggtagggaaacggggtacccgtaacgttaccaacccgtattcccgtacccgaaacggaaccgaaacccaaacccgttaacccgaaaacgtaaacctaaccgttccgttacgttacccttaccctaaacccgtaaaacgttaccgaaaccgtacggtacccgtagggaacgggacgggaccggaacgggaaccgacgggtaccgtaggttacgttaaacgttacggtaggtaacggacggaaggtacggacgtaccgaacgacgtaacggg

SEQ ID NO: 387231 - DNA, 571 bp, Homo sapiens
  misc_feature: GZ8MTXP02JV3KX.22.86.H09.1.454.CMB.2.raw
  modified_base (226)..(226): a, c, t, g, unknown or other
  modified_base (378)..(378): a, c, t, g, unknown or other
  modified_base (384)..(384): a, c, t, g, unknown or other
  modified_base (544)..(544): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctgggagtgggtgcaattatatggtatgatggaaagtaataaagactatgtggactccgtgaaggccgattcacatctccagagacaactccaaagaacactctcgttcaccaaatgaacagcctgagaggcgagacacggcagtntatacngtgacgagagatacgacagtacgaacgtaaacggggaaattcgtttagacttcgtacggtacgggggaccaaggggacctacggttacggtcctaacccgttctccttacgacgccctacccgaccgaacgggcccctaacgtcccgtcccttcccccgnggccctcccgtcgcctccgaggacccg

SEQ ID NO: 387232 - DNA, 583 bp, Homo sapiens
  misc_feature: GZ8MTXP02FPD71.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggagtgggtggctaattatatggtatgatggaaataataaagactatgtggactcgtgaaggcgatcacatctccagagacaactccaaagacactctcgtttacaccaaatcgaaacacgcctgagacgggcgaaggaccacggctagtagtattacgtgtgacgagacgatacgacagtagacgtaacgggaaagtcttttagatcgtacggtacgggacccgaagggacacgtcggtcctaccgtctcttacgacgtccctaccgaacccgaaacgggcccctaacgtcccggttacccttcccccgtcggcccgtcccgtcgcccgtaccgacggggtaacccg

SEQ ID NO: 387233 - DNA, 653 bp, Homo sapiens
  misc_feature: GZ8MTXP02F6GGB.22.86.H09.1.454.CMB.2.raw
  modified_base (365)..(365): a, c, t, g, unknown or other
  modified_base (375)..(375): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctgggtggagtcgtgggggaggcgtggtccaggccgtggggacggtccctgagactctcctgtgcagcgtctgattccaccttcaggtgctagtggcatcgctacgtcggcctccggccagggccgtccggggacgaagggggtctaggggagtggggtgacctaaagttntagtggttanaggagtaggggaaaataaagttaaaacggcttaggtaggtacgggtaaccgtaccgggtagggaaacggggtcctaagttacccaaccctagtccctaccgaagaacgtaaacctaaactaaccgaaagtaaacctacttacttacgttttacccaaactaaacgtacgaaacacggtaccgtaggaacgacgggacggaacggaccgacgggtacgtaacgtcgttaagttacgtgtacgaacggagacgacgtacgacgtaagtacggtaaaacgg

SEQ ID NO: 387234 - DNA, 608 bp, Homo sapiens
  misc_feature: GZ8MTXP02FXF8E.22.86.H09.1.454.CMB.2.raw
  modified_base (245)..(245): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggnggacaattatagtggtatgataggaaagtaaataaagactatgtggactcgtggaaggcgatcacatctccagagacaactaccaaagaacactctcgtttacaccaaatgaacagcctggacgaggcgagacacggcagtgtattacgtgtgcgaagagactacgacagtacgaacgtaacgggaaagttcttttagacttacgtcgggtaggggacccgaaaggggacacggttacggtcctaaccgttcttccgtttaccgacgtccctaccgaaacccgaacggggcccctacggttcccgggttacccttcccccggtcggtccccgtccccgttacgccgtacccgaacgggacccg

SEQ ID NO: 387235 - DNA, 681 bp, Homo sapiens
  misc_feature: GZ8MTXP02FHBL3.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcaccttcagtggctatggcatgcacgtggcctccgccgaggccgtcccggggcgaagggggctggggaggtggggtgaccctaaagtttagagttgggtatggaagttaggggaaagttaaaataaaaggtacttaagtggtacgggaaccttccgggtaggaaacggggtcccgtaagtttacccaacccgtactaccctaccgaaacgaacgaaaccaaacctacccgaaacgaaacctaccttacgttacgttttacccaacccgtaaaattacgaaaccacgtacccgtagggaaggacgggaccggtaaacgggacccgaacgggaccgtaaggttacgttaacgtttaaccgtggttaccggaacggaaaggaacgacgtaaccggaactaacggtacggtaaaacccggg

SEQ ID NO: 387236 - DNA, 542 bp, Homo sapiens
  misc_feature: GZ8MTXP02GL5GD.22.86.H09.1.454.CMB.2.raw
  modified_base (311)..(311): a, c, t, g, unknown or other
  modified_base (499)..(499): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcatggctccgccaggcctccgggnaggggctggagtgggtgcaagttatagtggtatgataggaaagttaataagactagtggtggaacctcggtaggaacgggccattccacctatctaccgagacgacaactaccaaagaacactctagtttcctaccaaatcgaacacgcctaggagacggcgaggacacggacaggtagtacttacgnggtcgacgagagaagtcgacacgtgaacgtaacgggaatttcg

SEQ ID NO: 387237 - DNA, 609 bp, Homo sapiens
  misc_feature: GZ8MTXP02FU6IB.22.86.H09.1.454.CMB.2.raw
  modified_base (366)..(366): a, c, t, g, unknown or other
  modified_base (390)..(390): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcagtggctatggcatgcactggcctcccgccagggcctccgggcgaaggggctgggagtggggtggactaattanagtggtatggaatggaaattaaanaaagactagtgtggacgtccggtaggaacgggccgattacaccgatcctacagacgaacaactaccaagaaccactccttagtttaccacctaaaatcgtaaacgcgtacccgtaggaacggacgggaccgtaaacgggaaccaaccggggtaccgtaaggttacgttaaacgtttaccgtagggttacggaaccggtaaggaacggacgttaaaccgg

SEQ ID NO: 387238 - DNA, 531 bp, Homo sapiens
  misc_feature: GZ8MTXP02FOIF1.22.86.H09.1.454.CMB.2.raw
  modified_base (501)..(501): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctcccgccaggcctccggggcaaggggctggggagtggggtggacctaattagtagtggtatggaatggggaaataaataaagactagtgtgactcgtagaaggccgattcacatctaccagagacaactaccaaagaacctactcttctttaccacctaaaatcgaacagacctagagaggcgaagacgacgcagtcgttatacgngtgaacggagagactcgacagtagtaacgg

SEQ ID NO: 387239 - DNA, 583 bp, Homo sapiens
  misc_feature: GZ8MTXP02IWB3F.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcatgctacgtggcctcccgccgaggccgtcccgggcgaaggggcctggggacggtggggtcggaccgtaattatagtggtatggatggggaaataaataaagacttagtagtggactcggtgaacggccgatcacatcctcagaacgacaactaccaaagaaccactcttacgtttacacccaaaagtacgaactacgaccgtaggaacggacggacggaacgggaccgaacgggcctaaggttggtaacttacgtggtaggaacgaggtaaggactacgaacagtaacggtaaaccgg

SEQ ID NO: 387240 - DNA, 612 bp, Homo sapiens
  misc_feature: GZ8MTXP02FVITR.22.86.H09.1.454.CMB.2.raw
  modified_base (253)..(253): a, c, t, g, unknown or other
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattanatggtatgataggaaagtaataaagatatgtggactcgtgaaggcgatcacatctcagacgacaactaccaaagaactactctcgtttacctaccaaaatcgaacagacctggagaggacgagacacggcagtcgtattacngtgacgagagagtcgaacagtagacgtaaacgggtaaattcgtttagacttcgtacggtacgggaacccgaagggtacacggttcggtacctaccggttctaccttacgaccgtaccctacccgaaccggaaaccggggtcccctaacggttcccggttccccgttcccccggtcggtccccgtcccccgtggtaccctaccggaacggtaccccgg

SEQ ID NO: 387241 - DNA, 634 bp, Homo sapiens
  misc_feature: GZ8MTXP02G1MMP.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcagtgcacgtggcctccgccgaggccgtcccggggacgaagggggcctggggacggtggggttggaccctaaagttagtagtcggttatgaagttggggaaataaagtaaagacttagtggtacggacgtccgtaggtaaacgggcgtagttaccaaccgtactccgtaccgaagaacgaccaaacctaccgaaacgaacctaacttacgttacgtttacctaaccgtaaaattacggaaactacggcccgtaggaaggacgggacgaacggggacacgggtacgagttacggtacttaacggtgtacgcggaaaggactagtaccgacgtaacgttacggaaaaccggg

SEQ ID NO: 387242 - DNA, 612 bp, Homo sapiens
  misc_feature: GZ8MTXP02IATYX.22.86.H09.1.454.CMB.2.raw
  modified_base (173)..(173): a, c, t, g, unknown or other
  modified_base (292)..(292): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctgggtggagtcgtgggggagcgtggtccaggccgtggggagtccctgagactctcctgtgcagcgtctggattcaccttcagtggctatggcatgcntgcctccgccaggctccggggagtaggggttgaggtgggtgactaagttatagtggtatggaatagggaaattaaataaagcttagtgtacggacttccgggaggaacgggtcccagtttaccacgtactacctaccgaagtaacgaaacctaacctaaccaaagtaacctaccgttacgtttactttaccaaaccgtaaataccgaacgtacgtaccgaggaagggcggaacgggacggaacgtcgggataaggttcgtagtacgtgagacgagtagacgtaacgactaagacgtaaacgtacgggtaactttcgtacg

SEQ ID NO: 387243 - DNA, 671 bp, Homo sapiens
  misc_feature: GZ8MTXP02IF26T.22.86.H09.1.454.CMB.2.raw
  modified_base (251)..(251): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgcaggctccgggcaaggggctggagtgggtgcaattntagtggtatgatggaaataataaagactatggtggactccgtggaacggccgtattcaccatctaccagagacaactaccaaagaacctactctcgtttacctacctaaaatcgaaactaggccctggaacggaggaccggaagggaccacgggtcgaagttggttaacttacgtaggtcgacggaagaggtatacggactaagttacgacgttaaacgggggaaaagtttccgttttaggtaagttccttaccggggttacgggggaaccccgaaagggggtaccctacgttcggggttaccctaccggttacttccgttaccaacggtccctacccgaacccgaacggggtacccctacgttcccggtcccttccccccggtggaccccgtccccgtcggccctccggaacggtcccg

SEQ ID NO: 387244 - DNA, 543 bp, Homo sapiens
  misc_feature: GZ8MTXP02HZ3Q5.22.86.H09.1.454.CMB.2.raw
  modified_base (264)..(264): a, c, t, g, unknown or other
  modified_base (411)..(411): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggaggcgtggtccagcctgggaggtccctgagactntcctgtgcagcgtctggattcaccttcagtggctatggcatgcactggctccgcaggcctccgggcaaggggctgggagtgggtgctaattatagtggtatgataggaaagtataaagctatgtgactcgtagaaggcatcacatcncagagacaactccaaagacactctagtttacaccaaatcgaaacacgtcctaggagtaagggacgaaggaaccgacgggactaaggtagtaacgtttaccgtaggttcggaacggacggtacgacgtaccgg

SEQ ID NO: 387245 - DNA, 687 bp, Homo sapiens
  misc_feature: GZ8MTXP02G0CYD.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgttgggttttcctcgttgcttcttttaagaggtgtccagttgtcaggtgcagcgtgggtggagtcgtgggggagcgtggtccagccgtgggacgtccctgacgtacctctcctgtgcagcgtctggattcaccttcagtggctagtgcatgcactggcctccgccaggcgtcccgggcgaaggggctggggagtggggtagacctaagttagtatagggtataggattaggggaaaagttaaaataaaacggtacttaggttaggtagggtaacccgttaccggggtaggtaaaccggggacccgttaacgttacccgaaccctaacgtcccgtaaccgaacgaaacgtaacccgaaaacctaacccgtaaaacgaaaccctacctttaccgtttacgttttaacccttaaacccaaaaagttaccgaaaaccgtcgtaacccgtaggaacggacgggaccggaaacggaccgacccggcgtaagttacgttagttaccggtgtacggaacgacgaagtacacgaatacgtaacgtaaacgg

SEQ ID NO: 387246 - DNA, 644 bp, Homo sapiens
  misc_feature: GZ8MTXP02HVST6.22.86.H09.1.454.CMB.2.raw
  modified_base (279)..(279): a, c, t, g, unknown or other
  modified_base (545)..(545): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgcaggctccgggacaaggggctgggagtgggtggactaattatagtggtatgataggaaataaanaaagactatggtggacctcggtaggaaggccgtattcgaaccatctaccgaagacgacaactaccaaagtaaccacttctcgtttaccacctaaatacgaacacgccgtaggaggacggacggaacgaacgacgggctaggtattaacgtacttggcgaggaagtagacgtacgaacagttacgaaacggtaaacggggtaaattcgtttgtaacgttcgtcgggtaacggggacaacggggactcggtacggtacctaccgttcncgtttaccacgttaccccaccgaccggtaaaccggccctacgttcccggttccctcccccggtacgcccgtcccggtaacgcccgtacgacggaccccg

SEQ ID NO: 387247 - DNA, 516 bp, Homo sapiens
  misc_feature: GZ8MTXP02F99DT.22.86.H09.1.454.CMB.2.raw
  modified_base (342)..(342): a, c, t, g, unknown or other
  modified_base (374)..(374): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctcccgccaggctccggggcaaggggctgggagtggggtggccaattnatggtatgatgggaaataaataaagactatgnggactccgtagaagggccgattcaccatctaccagagaacaactaccaaagaacactctgtttacctacaaatgaacagcctgagaggcgaggacacggcagtgtacttactgtgaacgagagactacgaacagtgaaacgg

SEQ ID NO: 387248 - DNA, 649 bp, Homo sapiens
  misc_feature: GZ8MTXP02GRJBK.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggacttcacccttcgaggttcggctagtggcctagtgctacgtcggcctcccgccgagggccgtcccggggacaagggggctggggagtggggtaggcctaaagttagtagtggtactgaagtgggaaattaaataaagctagtgtaggaccgtccgtaggaacgggcctagttaccacccgtataccctaccgaaggaacgaaacccaaccttaccgaaacgtaacctaccgttcttaccgtttaccaaccctaaatacggaaacacggtacccgttaggacggacgggtacggaacgggaccgacgggtactacggttagttaacgttaccgtaggtacggaacggtacggaagtacgtacggtaacgtacggttaacgtaaaccgggg

SEQ ID NO: 387249 - DNA, 618 bp, Homo sapiens
  misc_feature: GZ8MTXP02GMB90.22.86.H09.1.454.CMB.2.raw
  modified_base (227)..(227): a, c, t, g, unknown or other
  modified_base (252)..(252): a, c, t, g, unknown or other
  modified_base (391)..(391): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattntatggtatgatggaaagtaataaagactatgtggactccgtgaaggccgattcaccatctcagagacaactccaaagacactctcgtttacaccaaatgaacagcctgacgaggcgaggacacggacagtagtattacngtgcgagagactcgaacagtagaacgtacggggtaaagtcttttagacgttcgtacggtagggggacccaaaggggtacctaacggttcggtacccacccggttactcccgtttacgacgtcccctacccgaaacccgtaacggggcccccgtaacgttcccgggttcccctttaacccccggtcggccccgtcccccgttagacccttaccggaacggtaccccgg

SEQ ID NO: 387250 - DNA, 606 bp, Homo sapiens
  misc_feature: GZ8MTXP02GTFS0.22.86.H09.1.454.CMB.2.raw
  modified_base (217)..(217): a, c, t, g, unknown or other
  modified_base (222)..(222): a, c, t, g, unknown or other
  modified_base (237)..(237): a, c, t, g, unknown or other
  modified_base (315)..(315): a, c, t, g, unknown or other
  modified_base (357)..(357): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcacatctcctacactggaaccagcagtgatgttggtgttanaactntgtctctgtaccaangcaccaggcaacgccccagactcatcattatgctgtacaatacgccggtccctcgacgggtccctgactcgcttctcncggtctcaagtctcggacaaccgacggcctcccgacgacctntccgtcgtcgggccttaccgacggctagaacgagtggaggctaggtattacttacgtcgtcgtgtaccttcgtagtttcgacgacggtcctaccgtacgtacgttcggggttcgtaccggggcggtaacgggtaccgaacgcgtaccgtaccggttacgtacggtaccgaccgacccgtaacggtccctcccggtacccccgtcggtacccgtaccgttcctcccggtcccctccccttacccgtcccg

SEQ ID NO: 387251 - DNA, 681 bp, Homo sapiens
  misc_feature: GZ8MTXP02IZGY9.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggacgtccctgagactctcctgtgcagcgtctggattccaccttcgagttcggcttagtcggcagtcggcctacgtgggcccttcccggcgacgggtcccgtccggggacgaaagggggtcttggggaggttggggtacggacttaaagtttagtacgttggggttaatggtaaacgttagggaaaagttaaagtaaacgtacttagtcggttaggaaccgttccgggtaggaaacggggccttaagttaccaaccgtacgtaccgtacaaacggaaccgtaaccaaacctaccgaaaacgtaacctaaccgttcttacgtttacctaaaccgtaaagttacgaaactacggtaccgtaggaacggacggacggaacggacgtacggactaggtacgtaagtttacgaggtacgacggacgtagtacgtaacg

SEQ ID NO: 387252 - DNA, 577 bp, Homo sapiens
  misc_feature: GZ8MTXP02G11DN.22.86.H09.1.454.CMB.2.raw
  modified_base (277)..(277): a, c, t, g, unknown or other
  modified_base (359)..(359): a, c, t, g, unknown or other
  modified_base (385)..(385): a, c, t, g, unknown or other
  modified_base (403)..(403): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccaggcaaacgcccccagactcatcatttangctgtcaaataagcggccctcgacggggtccctgatcgcttctctggctccaagtctcggccaacgacggcctccctgaccntctcgtgggcctccgaggctagaagntaggagctgatttatacngtctgctctatttgcaggccgaccttacgtaccgttggggtcgttcggggacgggacgggaccaaggccgtacggtaaccccgtcgtacggtccaacggaccccgaagggccctcccggccccccgtcggtcccaccgttcccgtaccgttcccccgtccccttcccgtacccg

SEQ ID NO: 387253 - DNA, 683 bp, Homo sapiens
  misc_feature: GZ8MTXP02GZ5YF.22.86.H09.1.454.CMB.2.raw
  modified_base (621)..(621): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtcctgagctctcctgtcgcagcgtctggacttcaccttcgagtggctagtggcatcgctacgtcggcctccgccgagggccgtcccggggagaacggggcgtaggggaggtggggtacgacctaaagttagtagtaggtatggaagtaggggtaaattaaagtaaagtacttaagtggtacggaccgttccggaggaaacgggtcctaattaccaacccttatcccacgaagaaccgaacctaaccgtaaaccgaaagtaaaccctacctttcctttaacggtttacccaaaaccgtaaaagtccgaaaaccgacgtacccgtaagggaaggacgggtaacggaacggtaaccgacgggtacgtaaggttacgtaacgtttaccggnggtaacggaaggtaaacggtaacgtaacgtaacgaacggttaacggtaacggtaaaaccggg

SEQ ID NO: 387254 - DNA, 596 bp, Homo sapiens
  misc_feature: GZ8MTXP02HL2GH.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaaataaagactatgtggactccgtgaaggccgattcaccatctccagagacaactcaaagacactctcgtttctacaaatgaacacgctgagaggcgagacacggcagtgtattactgtgcgagagatcgacagtagaacgtaacggggaaagtcttttagacttcgtcggtacggggaccgaaaggggacctacgtacgggtcctaaccggttctaccgtttaccgacgtcccttacccaaacccgaaccggggacccctaacgttcccgggttcccttccccccgtcggccccggtccccttcgcccctaccgtacggacccgg

SEQ ID NO: 387255 - DNA, 622 bp, Homo sapiens
  misc_feature: GZ8MTXP02HK0AK.22.86.H09.1.454.CMB.2.raw
  modified_base (336)..(336): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggaggtcctgagctctcctgtgcagcgtctggattcaccttcagtggctatggcatgctacgtggcctcccgcgaggccgtccggggngaaggggctggggaggtggggtggactaagttagtagtgggtagttggaagttaggggaaaagttaaataaaaggtctagttggtacggtaacgtccggtagggaaacggggtcctattccaccgaattccgaccgaaggtacaaccaactaccgaaacgaactacttcttacgtttaccaacctaaagtacgaaaccacgtcccgtaggaacggacggaccggaaacggaccgacgggccgttaagttgtaaacgttacgtggtacggacgacggagtactacgg

SEQ ID NO: 387256 - DNA, 729 bp, Homo sapiens
  misc_feature: GZ8MTXP02H2S78.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctgagactctcctgtgcagcgtctggacttccaccttcgagtggctagtggcatgctacgtggccctccgccgagggccgtcccggggacgaaggggtctaggggtaggtggggtagacctaaagttagtagtggtatggaattaggggaaattaaataaacgtacgttaagttcggacggtaaccggttccgtaagggaaacggggtacccgtaagtttacccaaccgttaagtcccgtacccaaaagggaaaccgaacctaaaaccgttcccgaaaaaacggtaacccttaaaccttttcgtttaaaccggttttaccctaaaccccgtaaaaagttaccgaaaaccgttacggacccgttaaggaacggggaacgggaccggaacgggaaaccggtacgggaactaagggttacgttaacgttaacggtggtacgggaaccgaaggtaaagtacgttacggaaacctaggtttaacggtaaaccggg

SEQ ID NO: 387257 - DNA, 654 bp, Homo sapiens
  misc_feature: GZ8MTXP02IMFX1.22.86.H09.1.454.CMB.2.raw
  modified_base (239)..(239): a, c, t, g, unknown or other
  modified_base (254)..(254): a, c, t, g, unknown or other
  modified_base (633)..(633): a, c, t, g, unknown or other
  modified_base (638)..(638): a, c, t, g, unknown or other
tcagacatacgcgtcacgaccggtgctcgatttagtgctatagacttgggtttgggctgagctgggttttcctcgttgctcttaaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggggcaaggggctgggngtgggtgacaattanatggtatgataggaaataaataagactatggtggaacgtccgtaggaacggccattcaccatctacagacgaacaactccgaaagaactacttctacgtttaccacctaaagtacgaaacacgcctaggacggacggacgtacgggaacacgggacgtaggttagttaagtttaccgttaggtacgaccggaagaaacgtacgttaccggaaccgtagtaacggtaaaccggttaaaacgggggtaaacgtttaccgtttgggtaacctcggttaccggtaacgggggacccccgtaaagggggtacctacgtacgggttccaaccggttctccgtacacgtcccacgccgaacggtcccacgtcccgtcctcccccgngcccncctcgcctacgacggc

SEQ ID NO: 387258 - DNA, 515 bp, Homo sapiens
  misc_feature: GZ8MTXP02GR1T1.22.86.H09.1.454.CMB.2.raw
  modified_base (227)..(227): a, c, t, g, unknown or other
  modified_base (233)..(233): a, c, t, g, unknown or other
  modified_base (363)..(363): a, c, t, g, unknown or other
  modified_base (371)..(371): a, c, t, g, unknown or other
  modified_base (376)..(376): a, c, t, g, unknown or other
  modified_base (381)..(381): a, c, t, g, unknown or other
  modified_base (396)..(396): a, c, t, g, unknown or other
  modified_base (425)..(425): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccngcagtnatgttggtgttataatatgtctcctgtaccaacagcacccaggaccaaacgcccccagacctcatcatttatgctgtcaatacgcgccctgacgggtccccctgatcgcttctctgcctcagtctgcacncgcctccngaccntctcnggctcgagctagagngtagagtctgtattattactgtctgtctntatttgacgtagggcctccgtacgtacgttcgggtcgttcgggacgggacggaccagcgtacgaccgtccgtaggtcacgcccgtaacgg

SEQ ID NO: 387259 - DNA, 689 bp, Homo sapiens
  misc_feature: GZ8MTXP02GCKQV.22.86.H09.1.454.CMB.2.raw
  modified_base (230)..(230): a, c, t, g, unknown or other
  modified_base (500)..(500): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcctccggggngaaggggctgggaggtgggtgacaattatagtggtatgagtaggaaagtaaataaagactagtgtggactccggtagaacggccgtattccaccatcctaccgaagacgacaacctaccaaagaacacttctacgtttacctaccaaagtacgaacacgcctggacggacggacggaggaccacgggtactaaggttcgttaatttacgtggtaggcgtaaagagagtacgaactaagtacgaacgtaaacggggtaaattcggttttanagttccggtacgggtacggggaaacccgaaaggggtactacggttcggtaccctaccgttactccgttaccacgtccccctaccggaaaacccggaaccgggtccccttacggttcccccggtttaccccttcccccgggtggtacccccgtccccggttcggacccgttacccggaacgggtaacccg

SEQ ID NO: 387260 - DNA, 592 bp, Homo sapiens
  misc_feature: GZ8MTXP02IUUY3.22.86.H09.1.454.CMB.2.raw
  modified_base (294)..(294): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactccgngaaggccgattcaccatctccagagacaactccaaagaacactctcgtttacctaccaaatacgaacacgcctggagaggcgagacacggcagtgtattacgtgtgcgagagatacgacagtagacgtaaacgggaaattcgtttagattccgtggtacggggaccgaagggacacgttacggtcctaccgtcttccgttcaccgtaccctacccgaaccgaacggggtcccctacgtcccgggttccccttcccccggtcggccccgtccccgtacgcccgtaccgaacgggtcccg

SEQ ID NO: 387261 - DNA, 523 bp, Homo sapiens
  misc_feature: GZ8MTXP02FEZ7I.22.86.H09.1.454.CMB.2.raw
  modified_base (254)..(254): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattanatggtatgatggaagtaataaagactatgtggactccgtgaaagggccgattcaccatctccagagacaactcccaaagaacactctgtttctccaaaatgaaacagcctgagaggcgaggacacggcagtgtattactgtgcgagagatcgacatgactacggggaaagcttttgatctcgtggggccaagggacacgtggtcaccgtctcttcacgcctccaccaagggcccatcggtctcccccgtggccgccctgctccaggacg

SEQ ID NO: 387262 - DNA, 703 bp, Homo sapiens
  misc_feature: GZ8MTXP02IXY0V.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagctctcctgtgcagcgtctggattcaccttcagtggctagtggcatgcacgtggcctccccggccgacgggccgtcccggggcgaaggggctggggaggtggggtggacctaaagtttatagtggggttaatggaagttaggggtaaaagttaaaagtaaaaggtacttaagtgggtagggtaacccgttcccgggtaggaaacggggtcccgtaagtttacccaaccctattccctaccgaacgaacgaacctaaacctacccaaaacgtaaacctacctttacttacgttttacctaaccctaaaaagttcgaaaaccgtaacggcccgttaaggaacggaaacggggaacccgggaaagggtaaccccgaaaccggggaccgtaaagggttacgtttaacgtttaaccgtggtaggaacggaaggtaagacgtacggaaacctagttacggtaaaccggg

SEQ ID NO: 387263 - DNA, 680 bp, Homo sapiens
  misc_feature: GZ8MTXP02IH0P2.22.86.H09.1.454.CMB.2.raw
  modified_base (370)..(370): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcgtgggtttcctcgttgctcttttaagaggtgtccagtgtcaggtgcagctggtggagtcgtgggggagcgtggtccagcctgggaggtccctgagctctcctgtgcagcgtctggattcaccttcagtggctatggcatgcacgtggcctcccgccaggcctccggggacaagggggctggggaggtggggtgactaaagtttanattggggtatggaagtagggaaagttaaagtaaaagtactaagtggtacggtaaacgtcggtaggaaacggggtccgtaacgttacaccctaatacctaccgaaaggaacgaaaccctaaaccgtacccaaaacgaacgtaaccttccttacggttttaccttaacccgaaaattacggaaaccaaaggttccccgtaaacggaggggaacgggtaacccggaaaggggaaccgtacccggggaacgttacggtttagtaaaccgtttttacgggtacggttacggacggtaacggtaacgacgtaacgg

SEQ ID NO: 387264 - DNA, 563 bp, Homo sapiens
  misc_feature: GZ8MTXP02FLE4C.22.86.H09.1.454.CMB.2.raw
  modified_base (393)..(393): a, c, t, g, unknown or other
  modified_base (538)..(538): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggcctccgggcaaggggctgggagtgggtggcaattatatggtatgatggaaagtaaataaagactatgtggactccgtgaaggcgattcaccatctccagacgacaactaccaaagaacactctacgtttctaccaaatgaacagcctgagaggcgagacacggcagtgtattacngtagcggaagagactacgaacagtagactaaacggggaaactgtttagatcgtaccgtaggggaccaaggggactacgtcggtaccgaccgtcgtaccttacacgtccctaccaccgaacgggcccctagtccgtccttccccgngcccgtcccacgcctcccgaggccc

SEQ ID NO: 387265 - DNA, 544 bp, Homo sapiens
  misc_feature: GZ8MTXP02FOCYC.22.86.H09.1.454.CMB.2.raw
  modified_base (331)..(331): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtgactcgtgaaggcgatcacatctcagagacaactccaaagacactctnttctaccaatgaacacgctgagaggcgaggacacggcagttgtattacgtgtgcgagagatcgacatacgacgtaagggaaatctttgattctcggtacggggacccaaggggacacgtgtacctaccgtctcttcacgccctaccgaccgaacgggtcccacgttcccggtcccttccccgtcggcccgtcccgtcgcctaccgacgacccg

SEQ ID NO: 387266 - DNA, 723 bp, Homo sapiens
  misc_feature: GZ8MTXP02JZ52H.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcggtggtccagccgtgggacggtccctgagactctcctgtgcagcgtctggacttcaccttcaggtgctagtggcagtcgccacgtggcctccccggccgacggccgtcccggggacgaggggcgtggggacggtggggtgacctaattagtagtggtatgaagtagggtaaagtaaagtaaagacgttagtgggtacgggtacctaccgggtacgggaaacgggtcccgtactttaccgaacccgtacttacccgtaccgaacggaaacgaaaccctaaaccgttaacccgaaaacggtaaaccctaacctttaccgtttaccgttttacccctaaaacctaaaagttaccgaaaccgtacggtacccgtagggaacgggacgggaacccggggaacggaaccggaaccgggtaccgtaaggtttaccggttaagtttaccggttaggacggaacggacggtaaaggtaccgtaaccggtaaccgtaggtaacggttaaaaccgggg

SEQ ID NO: 387267 - DNA, 577 bp, Homo sapiens
  misc_feature: GZ8MTXP02JFOLY.22.86.H09.1.454.CMB.2.raw
  modified_base (325)..(325): a, c, t, g, unknown or other
  modified_base (389)..(389): a, c, t, g, unknown or other
  modified_base (398)..(398): a, c, t, g, unknown or other
  modified_base (552)..(552): a, c, t, g, unknown or other
  modified_base (563)..(563): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtggactaattatagtggtatgataggaaagtaaataaagactatggtaggactccgtgaaggccgtatcacatctcaganacaactcaaagacactctcgttacaccaaatcgaacagacctgagaggacgagacgacgcagtntacttacgngtgacgaagagactacgaacagtacgaacgtaaacggggaaattcgtttaagattccgtacgggtacggggaacctaagggaccacgtcggacctaccgtctacgttcaacgcccctaccgaacgaacggtcccacgttccggcccttccccgnggccctcccgngcctaccgaggacc

SEQ ID NO: 387268 - DNA, 524 bp, Homo sapiens
  misc_feature: GZ8MTXP02IAHEM.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtggactccgtgaaggccgattcaccatctcagagacaactccaaagaacactctcgttctaccaaatgaacagcctgagaggcgagacacggcagtgtatactgtgcgagagatcgacatagactaacgggaaagtctttagattactgtgggaccgaaggacactcggtcaccgtctcttcagcctcaccgaacggcccacgtccgtcctccccgtgccgccctcgtcctcgacgaccg

SEQ ID NO: 387269 - DNA, 574 bp, Homo sapiens
  misc_feature: GZ8MTXP02HS066.22.86.H09.1.454.CMB.2.raw
  modified_base (354)..(354): a, c, t, g, unknown or other
  modified_base (362)..(362): a, c, t, g, unknown or other
  modified_base (394)..(394): a, c, t, g, unknown or other
  modified_base (411)..(411): a, c, t, g, unknown or other
  modified_base (431)..(431): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggggcgaagggcgtggaggtgggtggcaattatatggtatgataggaagtaaataagaactatgtggactcgtgaaggccgatcaccatctccagagacaactacaaagaacactctcgtttctaccaaanagtacacnctgagaggcgaggacacggcagtgtattacgngtgcggagaggatcganagtgaacacggggtaaactntttagatctacggtggggccctaaagggactactcggtccacccgttctactcccgaagtccctaccccaacggtaaaccgggtccccacgttcccggtcccttcccccgtggcccgtccccgtagtcccctcggacggaccg

SEQ ID NO: 387270 - DNA, 675 bp, Homo sapiens
  misc_feature: GZ8MTXP02HYWT2.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcgaaggggctgggaggtggggtgctaattatagtggtatgagtaggaaataaataaagactagtggtaggacgtccggtaggaacgggccgtacttccaaccatacctacccaagaacgaaccaactaccaaagaaacctacttcttacgtttaccaaccaaatagaaacacgctggaggaagggccggaacggaccgacggtactagttagttattacgtgtacggacggtaaggaagacgttacgaactaagtacggtaacgtaaacggggtaaaagtttccgttttagtacgttacggtcgggtacgggggaaccgtaacggggacctacgttcgggtaccctccgtcttacccgtcaccgtccctaccaaacccggaaccggtccctacgttccccgttcccgttcccccgcggccccgtcccgtcggccctacgaacggacccg

SEQ ID NO: 387271 - DNA, 728 bp, Homo sapiens
  misc_feature: GZ8MTXP02GUT2P.22.86.H09.1.454.CMB.2.raw
  modified_base (190)..(190): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttnagtggctatggcatgcacgtggcctccgccaggccgtccgggagaagggggctgggaggtggggtgactaattatagtggtatgagtaggaaagtaaataaagactagtggtaggacctccggtaggaacgggccgtattccaacctatcctaccgaaggaacgaacctaacctacccaaaagaacctaacctttcgtttacgtttacccctaaccgtaaaaagttcgaaaaccacggtacccgtaggggaaacggacggggaaccggaacggggaacccgaacgggacgtaaaggtttaagttaactttaaccggtggtacgggacgtaaggaacgtaccgtacggaacaggttacggaaaaccgttaaacgggggtaaatttcgttttaggaacttccggtacgggtcggggaacctaaggggctacggtcggtacctaccgtcttccttacgaccgtaccctaccgaaccgaacgggtccctcgttcccggtttcccctcccgtcggccctcccgtagcccgtacgaacggaccc

SEQ ID NO: 387272 - DNA, 529 bp, Homo sapiens
  misc_feature: GZ8MTXP02JV0JE.22.86.H09.1.454.CMB.2.raw
  modified_base (275)..(275): a, c, t, g, unknown or other
  modified_base (315)..(315): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttnagtggctatggcatgcactggctccgccaggcctccgggnaaggggctgggagtggggtgcaaattatagtggtatgatggaaattaataagactagtggtgactcggtagaacgggccgtatcacatctcagagacaactacaagaacactctgttactacaatcgaacagctagagaggacgaggacgacggcaggtagtacttacgtgtcgacggagagaatacgactactagacgtacgggaaagtttcg

SEQ ID NO: 387273 - DNA, 534 bp, Homo sapiens
  misc_feature: GZ8MTXP02FOWPJ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactatgtggactccgtgaaggccgatcacatctcagagacaactccaaagaacactctcgtttactaccaaatgaaacagcctgagaggcgaaggacacgggcagtagtattacgtgtgcgagagatcgacatagaacgtaacgggaaagtctttgattctcgtaggggccaagggacacgtggtccaccgtctcttcacgcctccaacgacggcccacgtccgtcctccccgtgccgccctgcctcgacggacg

SEQ ID NO: 387274 - DNA, 661 bp, Homo sapiens
  misc_feature: GZ8MTXP02I7CBI.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcggtggtccagccgtgggacggtccctgagctctcctgtgcagcgtctggattccaccttcagtggctagtggcagtgcacgtggcctcccgccgaggcccgtcccggggacgaagggggctaggggaggtgggggtcgacctaaagtttagtagttgggttaatggaagtaggggaaattaaaagtaaaacgacttagtggtacggacctaccggtaggaaacgggtccgacgttaccaacccgtattccctaccgaaacgacgaaaccaaacctaccaaaacgaaaccctaccccttagtttaccctaaccgaaaagttacgaaactacggacccgtaggaaggacggacggaacggaccgacggactacggttagttacgttaacgtggtacgacggtaaggacgtacgtacggaacgtagtacggtaacgttaaaacgggg

SEQ ID NO: 387275 - DNA, 637 bp, Homo sapiens
  misc_feature: GZ8MTXP02JGQ6K.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcggtggtccagccgtgggacggtccctgagactctcctgtgcagcgtctggattcaccttcagtggctagtggcatgcacgtggcctcccgccgagggccgtcccggggacgaagggggtctaggggaggtggggtacgacctaattagtagtgggtatgaagtagggaaattaaataaagacttagtggtacggactcgggtagaaacgggcctattccgacctatccaccgaagacgaacactaccaaagtaacctacttcttagtttacccaaacctaaagtacggaaacacggtaccgtaggaaggacggaccggtaaacggaccgacggggacctaaaggtttacgttaacgttaccgtaggggtgaaaccggaaggaacggtacgttacggaacttaggaccggttaaaaccggg

SEQ ID NO: 387276 - DNA, 694 bp, Homo sapiens
  misc_feature: GZ8MTXP02H8H59.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaaggggctgggaggtgggtggactaattatagtggtatgagtaggaaagtaaataaagactaagtggtacggactccggtaggaacgggccgtattaccacctatcctaccaagacgaacaactaccaaagaaacctactcttacgtttacctaacctaaatacgtaaacacggaccctaggaacgggacggaccggaaacggggaaccgacggggactaagggttcgtttaaacgttacgtggtacggacggaagaagtaacgtacgaacagttacggaaacgttaaacgggggtaaatttccgttttagacttcgtacgggtaggggaaccaaaggggacctacggtcggtacctacccggttctccgttacgaccgttcccaaccgaaccggtaccgggcccctacggttcccggttccccttcccccggcgcccgtcccgtcgtaccctaccgacggacccg

SEQ ID NO: 387277 - DNA, 646 bp, Homo sapiens
  misc_feature: GZ8MTXP02GHE78.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctgagactctcctgtgcagcgtctggattcaccttcagtggctatggcatgcacgtcggcctcccggccaggccgtcccggggacgaacggggctggggaggtggggtggacctaaagttagtagtgggttatggaagttaggggaaattaaataaaggtacttagtggtacggaccgttccgtaggaaacggggccgtattccaaccctactccgtaccaagtaacgaaccaaaccgtacccaaacgtaaacctacgttacgttacgtttacctaaccctaaaagtccgaaactacggacccgtagggaacggacgggaccggaaacggaccgacgggtacaaggttacgttaagttaccgtggtacgaacggaagacggactcggaactaggtacggtaaaccgg

SEQ ID NO: 387278 - DNA, 615 bp, Homo sapiens
  misc_feature: GZ8MTXP02IHSMO.22.86.H09.1.454.CMB.2.raw
  modified_base (586)..(586): a, c, t, g, unknown or other
tcagacatacgcgtcacgaccggtgctcgatttagtgctatagacttgagctctgggagaggagcccagcactagaagtcggcggtgtttccattcgctgatcagcactgaacacagaggactcaccatggagtttgggctgagcttgggttttcctcgttgcttcttttaagaggtgtccagtgtcaggtgcagcgtggtggaggtcggtggggggaggcgtgggtccaggcccgtggggacggtccctggacgacttctcctggtgcaggcgtctggtacttccacctttcaggtggctagtggcatcgcacgtggccctcccggccgagggcccgtccggggacgaacggggcgtggggaggtggggtcgactaaagttagtagtggtatagagtaaggtaaaataaacgtaaagactagtggtggaccgttccggtaggaacgggccgaattccacctattccgacgaagacgaacaaactaccaaagaaactactcttacgttacaacctaaagtacgaaactacgaccgtaggacggacggacgacgggacaccggtagacggttagttaactcgtaggngtacgaaggagagtccgacgagtaccggg

SEQ ID NO: 387279 - DNA, 504 bp, Homo sapiens
  misc_feature: GZ8MTXP02IFLAZ.22.86.H09.1.454.CMB.2.raw
  modified_base (316)..(316): a, c, t, g, unknown or other
  modified_base (341)..(341): a, c, t, g, unknown or other
  modified_base (404)..(404): a, c, t, g, unknown or other
  modified_base (496)..(496): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttggggctgagctgggttttcctcgttgctcttttaagaggtgtccagtgtcaggtgcagctggtggagtcgtgggggaggcgtggtccagccgtgggaggtccctgagactctcctgtgcagcgttctggattcaccttcagtggctatggcatgcactggcctccgcaggctcccggggnaaggggctggagtgggtggcaattntatggtatgatgggaataataaagactatggtggactccgtgaaggcgatcaccatctcaganacaactccaaagaacactctagttctaccaaatgaacagacctgagaggacgaggacacggacagtagtatactgtgcgagagatacgacanacgtaacg

SEQ ID NO: 387280 - DNA, 707 bp, Homo sapiens
  misc_feature: GZ8MTXP02FJVN7.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggacttcaccttcagtggcttagtggcatgctacgtcggcctcccgccgacgggccgtcccggggacgaagggggccttggggaggttggggtcggacctaaagtttagtagttgggtaatggaagttagggggaaaattaaagtaaaagtacgttaagttggggtacgggtaacccttaccgggtaggaaacgggggtccgtaactttccgaaccctagtccctacccgaaagaacgaaacctaaacctacccgaaaacgtaaacctacctaccgtttagttttaccctaacctaaaacgttagaaaactacggtacccgtaggaacgggaacggggacggaacgggaccgaaccggggacgtaaggtttaggttaacttttaaccgtggttaggaacggtaacggtaaggaacgttaccggaaacgtaacggtacggtaaaaccggg

SEQ ID NO: 387281 - DNA, 685 bp, Homo sapiens
  misc_feature: GZ8MTXP02JRC2T.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggtagtttgggctgagcttgggttttcctcgttgcttcttttaagaggtgtccagtgtcaggtgcagcgtggtggagtcgtgggggagcgtggtccagccgtgggacgtccctgacgtacctctccgtgtgcagtcgtctggtacttccaccttcgaggtcggcctagtggcagtcgcctaccgtggccctccccggcgacggccggtcccggggacgaacggggcgtggggacggtggggtacgtaccgtaagttagtagtaggttagtaggtaagtaggggtaaaagttaaaacgtaaaacgtacttaagtggtacggtaaccgtacccgggtaaggaacgggtaccctacgttaccaacccgtactcccgtaaccgaacgacgaaccctaaactaccgaaacgtaaacctacttcttacgtttaccaacctaaatacgaacagtccgtagaacggacggacgaacggacggacggtacgtaggttacgtaacgttacgtaggtacgaacggtagaacggtacgaccggtaacgacggtaacgtaaacccgggg

SEQ ID NO: 387282 - DNA, 754 bp, Homo sapiens
  misc_feature: GZ8MTXP02JB6AG.22.86.H09.1.454.CMB.2.raw
  modified_base (228)..(228): a, c, t, g, unknown or other
  modified_base (246)..(246): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggnaaggggctggaggtgggngactaattatagtggtatgagtaggaaagtaaataaagactagtggtaggactaccggtagaacggggcctaagttccaaccgtactcctaccgaagtaaacgaacctaaaccgtaccaaaagtaacctaacctttccttacgttttaccctaaaccctaaaaattaccggaaaaccacggtaccctaggggaaacgacgggggaaccggaaacggtaaccgaccgggaacttaggttaagttaacgttaaaccgtggtacggaacggaaggaagtacgtaaccggaacgtaagtacggtaaaacgttaaacgggggtaaaacgtttcgtttttaaggacgttcccgtacgggtacgggggaacccggaaaggggaccttacggtacggtaccgtaacccgttcttccgttaccgaccgtcccacccggaaccgaacccgggtcccaaccgttcccggttccccgtccccgtcggccccgtcccgtcgacccgttaccgacggacccg

SEQ ID NO: 387283 - DNA, 548 bp, Homo sapiens
  misc_feature: GZ8MTXP02JT4XK.22.86.H09.1.454.CMB.2.raw
  modified_base (508)..(508): a, c, t, g, unknown or other
  modified_base (534)..(534): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggtccagccgtgggagtccctgagactctcctgtgcagcgtctggattcaccttcagtggctatggcatgcactggctccgccaggctccgggcaaggggctggagtgggtgccaattatatggtatgatggaagtaaataaagtactaagtggtacggtactccggtagaaacggggccgaagttccacccgtatacctaccgaagtaagaccaactaccaaacgaactacttctagtttcctaccaaatagaacacgccgtagagaggcgacggacacggacacggtntagtacgtgtagcgagacgctacganacgtagtaaaccgg

SEQ ID NO: 387284 - DNA, 586 bp, Homo sapiens
  misc_feature: GZ8MTXP02HCVY7.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgtttgcttcttttaaggaggtgtccagtgtcaggtgcagctggtggagtcgtgggggaggcggtggtccagccgtgggaggtccctgagctctcctgtgcagcgtctggattcaccttcagtggctatggcatgcacgtggcctccgccgacggccgtcccgggcgaaggggctaggggaggtggggtgacctaagttatagtggtatggatagggaaagtaaataaagactagtggtgactccgtaggaacgggccgtattaccaccgtatcctaccacgacgaaccaacgtaccaaagaaccacttgttactttacaacctaaatacgaactacgacctaggagacgggaccgaagggaccgaaaggaccaggttacgtaagttacgtggtagaacgagaagtactacgacacgttacgaaaccgg

SEQ ID NO: 387285 - DNA, 605 bp, Homo sapiens
  misc_feature: GZ8MTXP02HZH2H.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagccgtgggacggtccctgagactctcctgtgcagcgtctggattcaccttcagtggctatggcagtgccacgtcggcctcccgccgaggccgtccggggcgaaggggctgggaggtggggtgacctaatttagtagtggtatgaagtgggtaaagtaaattaaacgacttaagtgtagacgtccgtagaacggggctacttcacctactcctacagacgacaactaccaaagaaacctacttacgttactttaccaacctaaatacgaaacacgcctaggaaggacgggacggaacgggaccgaaacggggtctaagggttagttacgttaacgtggtagaacggtaagaggtactacggaacgtagtaacggtaaacggg

SEQ ID NO: 387286 - DNA, 709 bp, Homo sapiens
  misc_feature: GZ8MTXP02JAV55.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagccgtgggaggtccctgagactctcctgtgcagcgtctggattccaccttcaggtggctagtggcatgcacgtcggcctccgccgaggccgtccgggacgaaggggcgtgggaggtgggtgactaattatagtggtatagagtaggaaagtaaataagatagtgcggtactcggaggacggccgtattaccgacctactacctacgaacgtaacgaaccaacctaccaaagaacctacttcttaccgtttaccaacctaaatacgaacacgtccgtagggacggaacgggacggaaacgggaaccgacggacgttagggtttacgttaagttcgttgggaacggagtaaggaagtcgtaaccgagtaagtacggaaacgtaaagggttaacttgttacgtagtccgtacggggaacgggaacccgaagtacccgtacgtacggtacccttaccgtcgttacccgttaccgacccgtacccctaacccgggaacggaccccggtaccttaccccgggttccgttcccccgtcccggcgtcccgtcccgtagcccgtaacggacgtacccg

SEQ ID NO: 387287 - DNA, 702 bp, Homo sapiens
  misc_feature: GZ8MTXP02JUWT7.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtctggattcaccttcagtggctatggcatgcacgtggctccgccaggccgtccgggcgaaggggcgtagggacggtggggtgacctaagttatagtggtatggatgggaaataaagtaaagtactaagtggtacgtaccgtccgggtaggaacgggacccgtattaccgaaccctagttacccaccgaaggaacgaacctaaacctaacccgaaaacgtaaaccctaaccttacgtttacgtttaccctaaacctaaaacgttacgaaaaccgtaacggtacccgttaagggaaacgggaaacggggaccgggtaaaaccgggaaaccggtaacccggggacgtaaagggtttaccgtttaaacgtttaaccggttcgggttagggaaccggtaaggaaccgtaaggttacccggaacgtaaagttacgggttaaaaacccgggg

SEQ ID NO: 387288 - DNA, 571 bp, Homo sapiens
  misc_feature: GZ8MTXP02GQWDA.22.86.H09.1.454.CMB.2.raw
  modified_base (227)..(227): a, c, t, g, unknown or other
  modified_base (362)..(362): a, c, t, g, unknown or other
  modified_base (368)..(368): a, c, t, g, unknown or other
  modified_base (418)..(418): a, c, t, g, unknown or other
  modified_base (441)..(441): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggctaattatatggtatgataggaaagtaaataaagactatggtgactccggtagaagggccattcacatctacagagacaactcaaagaactactctcgtttacacaaatcgaacngtaccngacgaggacgagacacggcagttagtattacgagtgacgagagatcgganagtagaacgtaacgggaaagttntttagattcgtcggtacgggaccaaggtacacgtcggactaccgtcttactcgactcctaccgaccgaacgggtccctaacgttcccggtacctccccggtcgccgtccccgtgacctccgacggacccg

SEQ ID NO: 387289 - DNA, 707 bp, Homo sapiens
  misc_feature: GZ8MTXP02GFYGD.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagctctcctgtgcagcgtctggattcaccttcaggtggctagtggcagtcgctacgtggcctcccggccgaggtcccgtccggggacgaaacgggggtctaggggtaggtgggggtaggaccctaaaagtttagtagttagggttaagtggaaagttaggggaaaacgtaaaattaaaacgtacgttagttcggtacgggaaccttcccgggtagggaaaccggggtccgtaattacccaaaccctagtcctaacccgaaggtaacaaaccctaaacgtaccccgaaaagtaaaccctaccgttcctttacggttttaacccaaaccctaaaaagttcggaaaacctacggtaccgtaggaaaggggacgggaaccgggtaaacgggaccaaccggggtactagggttacgttaattcgtggtaggaaccgaggaacgtatccggaataacgtcgtaaaacccggg

SEQ ID NO: 387290 - DNA, 701 bp, Homo sapiens
  misc_feature: GZ8MTXP02H2H30.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggagtccctgagactctcctgtgcagcgtctggacttcaccttcagtggctatggcatgcacgtggacctcccggccagggccgtacccggggcgaagggggcctggggacggtggggtggaccctaagttatagtgggtatggtaagtggggaaaagttaaaataaaacggacttaagtcgggtaggtaacccgtcccgggttagggaaaccggggtcccgtaactttacccgaaccctattacccgtacccaaggaacgaccaaactaccccgaaaagtaaacctacttacgttacgtttacctaacccgtaaaatacgaaaacccgagtcccgtaaggaaacgggacgggtaacccggaaagggaaccgtaacccgggacgtaacggttacgtttaagtttaccgttggtaggtaaccggaagggaaacgtagtaccgggaaactacggttaacggtaaaacccgggg

SEQ ID NO: 387291 - DNA, 652 bp, Homo sapiens
  misc_feature: GZ8MTXP02G0HS4.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaagggggctgggagtgggtggctaattatagtggtaatgagtaggaaataaataaagatagtgtggactccgtaggacggccgattccgaccatcctaccgaagacgaaccaactaccaaagtaaccaccttctcgtttaccacctaaatcgaaacagcctgagaggcgaggacacggacaggtacgttattactggtgacgaagacgagtcgaacgagtacggaacgtaaacggggtaaagttcttttaggacgttaccgtacgggtacgggggaaccgaaaggggacctacgttacgggtcctaccggtcttccgtactacccggccctaccccgaaaccggtaaccgggtcccctaacgttccccggttcccgttcccccgtcggaccccgtccccgtacggccctacccggaacgggtcccg

SEQ ID NO: 387292 - DNA, 621 bp, Homo sapiens
  misc_feature: GZ8MTXP02FK2E7.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacggtccctgagactctcctgtgcagcgtctggattcaccttcagtggctatggcatgcacgtcggcctccgcgaggccgtcccggggcaagggggtctggggaggtggggtagacctaaagtttagtagtggtataggaagttagggaaataaaataaagtactaagttggtacggacctccgggtaggaaacgggtcctattcccgaactatcctaccgaagacgaaacaacctaaccaaacgaaacctacttacttctttacctaacctaaaagtacgaaacacgccgtagacggacgggacgaacgggaccaccggactaaggttacgttaagttacgtggtacgaacggaagaagtacgtaccggaactagtacggaaaaccgg

SEQ ID NO: 387293 - DNA, 555 bp, Homo sapiens
  misc_feature: GZ8MTXP02FRKBH.22.86.H09.1.454.CMB.2.raw
  modified_base (386)..(386): a, c, t, g, unknown or other
tcagacatacgcgtcacgaccggtgctcgatttagtgctatagacttggctttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactccgtgaagggcgattcacatctcagagacaactcaagaacactcctgtttcaccaaatgaaacagcctgagaggcgagacacggcagtgtattacgngtgcgagagatcgacagtagaacgtaacgggaaatcgttttagacttcgtcgtacgggggaccaaaggggactacgtggtaccaccgtctcttcacgccctaccaccgtacgggcccacgtccggtcccttcccccgtcggcccgtccccgttcgcccgtaccgaacgg

SEQ ID NO: 387294 - DNA, 724 bp, Homo sapiens
  misc_feature: GZ8MTXP02JM2QO.22.86.H09.1.454.CMB.2.raw
  modified_base (271)..(271): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttnagtggctatggcatgcacgtggcctcccggccgagggccgtccggggacgaagggggtcctggggaggttggggtcggactaaagtttagtagtgggtaatggaagttagggaaaagttaaataaggtacttaagtgggtacggtaccgttcgggtaggaaacggggtaccctagttaccgaaccctattccctacccgaagtaaccgaaccaaaccctaccgaaaacgaaacctaccgttccgtttacgttttaaccctaaccctaaaacgttacggaaacccgtaacggtacccgtaagggaacgggtaacggggaccggaacgggaccgaaccggggtacgtaacggtttaggttaaacgtttaccggtaggttacggtaacggaaggtaagtaacgtaccggaaacgtaggttaacggtaaaaccggttaacggggtaaaacgtttcgg

SEQ ID NO: 387295 - DNA, 585 bp, Homo sapiens
  misc_feature: GZ8MTXP02GEPY4.22.86.H09.1.454.CMB.2.raw
  modified_base (343)..(343): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagccgtggggaggtccctgagactctcctgtgcagcgtctggattcaccttcagtggctatggcatgcacgtggctccgccagggcctccgggcaggggctggaggtggggtgcctaatntagtggtatgagtgggaaagtaaataaacgacttagttggtacggaccttcccgggtaggaaacggggtcccgaatttaccaaccctacgtcctacccgaagaacgacaaaccgtaccaaaagaacctacttacttgtttaccaccaaagtacgaacagtaccagaagacggacgaacggacgtacggacgagtgttactacgtaggtgaacggtagacgactacggactagtacgaaacgg

SEQ ID NO: 387296 - DNA, 513 bp, Homo sapiens
  misc_feature: GZ8MTXP02JY9B3.22.86.H09.1.454.CMB.2.raw
  modified_base (192)..(192): a, c, t, g, unknown or other
  modified_base (341)..(341): a, c, t, g, unknown or other
  modified_base (348)..(348): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagttttgggctgagctggggttttcctcgttgctcttttaagaggtgtccagtgtcaggtncagctggtggagtctgggggagcgtggtccagcctgggaggtcccctgagactctcctgtgcagcgtctggattcaccttcagtggctatggcatgcactggctccgccaggctccggggcaggggctgggagtggggtgccaatttanatggtanggatgggaaataataaagctagtgtgactccgtagaagggccgattcaccagtcctccagacgacaactaccaagaacactctagttactacaaatcgaacagcctagagaggcgaggacacggcagtacgtactacgtgtagcgagacgatcgacatacgaacg

SEQ ID NO: 387297 - DNA, 615 bp, Homo sapiens
  misc_feature: GZ8MTXP02GGRYU.22.86.H09.1.454.CMB.2.raw
  modified_base (227)..(227): a, c, t, g, unknown or other
  modified_base (397)..(397): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggctaattatatggtatgatggaaagtaataaagactatgtggactcgtgaaggccgatcacatctccagagacaactccaaagaacactctcgtttaccaccaaatcgaacagcctgaagaggcgagacacggcagtgtattactgtacgngaagagagtcgaactagtacgaacgttaaacggggaaatcgtttttagattccgtacggtacgggggaacccgaaaggggacctacggttcggtacctaacccgttcgttaccttaccgacgtacccctacccgaaacccggaaacgggcccctaacgtccccggtttacccttccccccgtcggtccccgtcccttccggacctccgaacggacccg

SEQ ID NO: 387298 - DNA, 609 bp, Homo sapiens
  misc_feature: GZ8MTXP02IPQSC.22.86.H09.1.454.CMB.2.raw
  modified_base (227)..(227): a, c, t, g, unknown or other
  modified_base (424)..(424): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggctaattatatggtatgatggaaagtaataaagactatggtgactccgtgaagggcattcaccatctacagacgaacaactaccaaagaacctactcttcgtttacctaccaaaatcgaacacgtcctggagacggacgagacacggcagtgtatactgtgcgaagagactacggaanatagacgtaaagggtaaagttctttagattccgtagggtaccggggacgaacgggactacgtcggtcctaaccgtctcttacaccgtcctacccgaaccgaaacgggcccctaacggttcccggttccccgtttcccccgtcggggtccccgtccccgtgtccccgttacccgaggggaaccccg

SEQ ID NO: 387299 - DNA, 696 bp, Homo sapiens
  misc_feature: GZ8MTXP02IDXK1.22.86.H09.1.454.CMB.2.raw
  modified_base (190)..(190): a, c, t, g, unknown or other
  modified_base (274)..(274): a, c, t, g, unknown or other
  modified_base (371)..(371): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtgggacggtccctgagactctccgtgtgcagcgtctggattcaccttnagtcggctagtggcagtcgcacgtggcctccgccgagggcctcggggacaaggggctaggggaggtggggtcgactaaagttagtacgtagggttanggaagtaggggaaaagttaaaataaaaccggtacttaagttgggtaacgtaccgttacccgggttaggaaaaccggggtcccgtaagttacccgaacctacgttaccacccgaaaggaacgttaaaccaaaacccgtaccaaaacggtaaacctaacgtttccgtacgttttacccaaaccgttaaaaagtaacgaaacgtaacgtacgtaacggaacggaacggaacggaacggaacggacggtacgtacggttacgttacgttacgtacggtacggtaacggaacggaacggtacgtaacgtaacgtaacgtaacggtaacgg

SEQ ID NO: 387300 - DNA, 800 bp, Homo sapiens
  misc_feature: GZ8MTXP02H7ZGP.22.86.H09.1.454.CMB.2.raw
  modified_base (193)..(193): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgtttgcttcttttaagaggtgtccagtgtcaggtncagctggtggagtcgtgggggagcgtggtccagccgtgggacggtccctgagactctcctggtgcagcgtctggacttcaccttcagtggctagtggctatcgctacgtcggcctccgccgacggccgtccggggcgaacggggcgtaggggaggtggggtaggacccaaagtttagtagtaggggttattagggtaagttaggggtaaaagttaaaataaaacggtacgttaagtacggggtacgtaccgtacccgggtagggaaacggggtcccgtaagtttacccgaacccgttaacgttacccgtaacccgaaacggtaaccgaaccgtaaaaccctaaacccgtaaaacggtaaaacccttacctttttaacccgtttaaccggtttttaaccctaaaccccggttaaaaattaaccggaaaaccgttaaccggacccggtttaaagggaaccgggtaaacgggggtaaccggaacggggtaaaacccggtccgggggaaaccttaacggggttacgtttaaacgtttaccggtagggttaacggaaccggtaaggaaggtaacgtaaccggaaaccgtaggttaaacgggtaaaacccggg

SEQ ID NO: 387301 - DNA, 541 bp, Homo sapiens
  misc_feature: GZ8MTXP02F127C.22.86.H09.1.454.CMB.2.raw
  modified_base (273)..(273): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaanaaagactatgtggactccgtgaagggccgattcaccatctccagagacaactccaaagacactctcgttctaccaaatcgaacagcctgagaggcgaggacacggcagtgtattactgtgcgagagatcgacatagactaacggggaaatcgtttagatcgtacggtggggaccaaaggggacacgtcggtcaccgtactcttcacgtcctcccacgaacggcccactccggtcctcccccgtgccgtccctgcctaccgaggacccg

SEQ ID NO: 387302 - DNA, 527 bp, Homo sapiens
  misc_feature: GZ8MTXP02IM3NI.22.86.H09.1.454.CMB.2.raw
  modified_base (273)..(273): a, c, t, g, unknown or other
  modified_base (312)..(312): a, c, t, g, unknown or other
  modified_base (363)..(363): a, c, t, g, unknown or other
  modified_base (477)..(477): a, c, t, g, unknown or other
tcagacatacgcgtcacgaccggtgctcgatttagtgctatagacttggggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcgtctggattcacttnagtggctatggcatgcacgtggctccgcaggctccgggnaaggggctgggagtggggtgcaaattatagtggtatgatagggaaattaanaaggacttaatgtaggtacctcggtagaacgggcgatcacatctaccagacgacaactaccaagactactctgttaccacaaatgaaactgccgtagagaggagtagacacggnagtgtatacgagtgacgagagaatcgactagtacgacgtaacggaacttg

SEQ ID NO: 387303 - DNA, 658 bp, Homo sapiens
  misc_feature: GZ8MTXP02J3CQT.22.86.H09.1.454.CMB.2.raw
  modified_base (189)..(189): a, c, t, g, unknown or other
  modified_base (413)..(413): a, c, t, g, unknown or other
  modified_base (653)..(653): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcacgtggcctccgccgaggcgtccgggcaaggggctgggagtgggtgactaattatagtggtatggataggaaagtaaactaaagactaagtggtacggaccgttccggtaggaacgggcccgtatttaccaaccactccgtacccgaagacgaaccaaacctaccaaagaaacctaccttcttacgtttacccacctaaaatcgaacncgccgtggaacgggtacggcgtaggacgacggacgtagtgttaaatacgtggtagacggaagagtatacgaacgtaagtacggaaccgttaaagggggtaaattccgttttaggacttcggtacgggttacggggaccaacgggggtacctaacggtcggtacctaccgtctccttaccaccgccctaccgaaccgacggtcccacgtcccggtccctcccgcgtccgcctcgctaccgngaccg

SEQ ID NO: 387304 - DNA, 699 bp, Homo sapiens
  misc_feature: GZ8MTXP02GAOM7.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggaggtccctgagactctcctgtgcagcgtctggattcaccttcagtggctatggcatgcactggctccgcaggcctccgggcgaaggggctggggaggtggggtggacctaaagtttatagttcggggttaatcggaagttaggggtaaaacgttaaaattaaaacggaaccttagtgggttagggaccctttacccgggtagggaaaccggggcccgtaatttacccaccctaactccttacccgaaggaacggaaaccaaccgttaccaaaacggtaaacctaacctttccttacggtttttaccaaacccgtaaaacgttaggaaaccctacggacccttagggaagtaacggggcggtaaaacggggaacccacggggcctaaaggttacgtttaacgttttaaccggtggtacggaaccggtaaaggaacggtacgtaccgaacgtacggtaacggtaaacgg

SEQ ID NO: 387305 - DNA, 593 bp, Homo sapiens
  misc_feature: GZ8MTXP02FZ82O.22.86.H09.1.454.CMB.2.raw
  modified_base (306)..(306): a, c, t, g, unknown or other
  modified_base (342)..(342): a, c, t, g, unknown or other
  modified_base (361)..(361): a, c, t, g, unknown or other
  modified_base (395)..(395): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggttgtccagtgtcaggtgcagctggtggagtcgtgggggaggcgtggtccagccgtgggacgtccctgagactctcctgtgcagcgtctggattccaccttcagtggctanggcatgcacgtggcctcccgccaggccgtccggggngaaggggctggaggtgggngactaattagtagtggtatgaagtagaagtaaanaaagtactagtgtaggactccggtaggaacggtaccgattaccgaacctactaccgtacgaaagaacgaacctaaacctaccgaaaactaacctacttaccttacgtttaccaactaaatacgaaacgacgaccgtagacggaggacgaacggacgacggactagtagttaagtacgtgtacgacgagagacgtaacg

SEQ ID NO: 387306 - DNA, 517 bp, Homo sapiens
  misc_feature: GZ8MTXP02H14QP.22.86.H09.1.454.CMB.2.raw
  modified_base (251)..(251): a, c, t, g, unknown or other
  modified_base (311)..(311): a, c, t, g, unknown or other
  modified_base (336)..(336): a, c, t, g, unknown or other
  modified_base (361)..(361): a, c, t, g, unknown or other
  modified_base (393)..(393): a, c, t, g, unknown or other
  modified_base (447)..(448): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctctttttaagaggtgtccagtgtcaggtgcagctggtggagtcgtgggggagcgtggtccagcctgggaggtccctgagactctcctgngcagcgtctggacttcaccttcagtggctatggcatgcactggctccgcaggctccgggnaaggggctggagtggggtgcaattntagtggtatgaatggaaagttaaanaaagatatgagactcgagagggcatcacatcncagacacaaactaccaaagaaacacttatacttttacaaccaaaatcggaaaannacgagagagacggacgacgacgacgagtacgtactacgtagtagaacgacgagacagacgactacgacg

SEQ ID NO: 387307 - DNA, 649 bp, Homo sapiens
  misc_feature: GZ8MTXP02IKOBM.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattccaccttcagtggctatggcatgcacgtggcctccgccgaggccgtccggggacaagggggctgggaggtgggtggactaaattatagtggtatgagtaggaaagtaataaagactagtggtggactccggtagaaggccgtattccacatctaccagacacaactaccaaagactactcttcgttacacaaatcgaacagcctggacgaggcggaagaccgaggctagtgttatacgtgtgacgagagacgtacgactagtacgaacgtaaacggggtaaacttcgttttagacgttacgtaccgggtacggggaccgaaaggggacctacggttcgggacctacccggttcttaccgttaccgaaccgtcccgtaccccgaaaaccggtaacgggtcccctaacggttccccggttacccttcccccggtcggcccgtccccgtacggtccctacgacgggtacccg

SEQ ID NO: 387308 - DNA, 596 bp, Homo sapiens
  misc_feature: GZ8MTXP02G9OXF.22.86.H09.1.454.CMB.2.raw
  modified_base (276)..(276): a, c, t, g, unknown or other
  modified_base (560)..(560): a, c, t, g, unknown or other
tcagacatacgcgtcacgaccggtgctcgatttagtgctatagacttgggtttgggctgagctgggttttcctcgttgctcttttaataggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggctaattatatggtatgatggaaagtaaanaaagactatgtggactcgtgaaggccgtattcaccatctcagagacaactccaaagaacactctcgtttacaccaaatcgaacagcctggagaggcgaaggacacggcagttgtattacgtgtgcgagagatcgacagtagaacgttaacgggaaattctttagacttcgtacggtggggacccaagggaccagttcgggtccaaccgttctcccgttacgaccgtaccctacccgaaaccggaaacggggtccccctaacgttccccggtccctttcccccgnggtccccgtccccgtgacccgttcccgagggacccg

SEQ ID NO: 387309 - DNA, 738 bp, Homo sapiens
  misc_feature: GZ8MTXP02FP4DO.22.86.H09.1.454.CMB.2.raw
  modified_base (173)..(173): a, c, t, g, unknown or other
  modified_base (273)..(273): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtggtccagccgtgggacggtccctgacgctctcctgtgcagcgtctgattcaccttnagtggctagtggcatgcacgtggctcccggccaggcctcccggaggacgggacgggtcgtaggggtacgggttggggtaccgtattaaagttagttaggttagggtataggtaggtaaagggtaaaagttaaaagtaaaagtacgttaaggtacggggtacggtaacccgttacggggtaaagggaacccggggtaccttaacgttaccctaaaccctacgttacccgtaacggaacggtaaacaaaccccgtaaaccttaaacccggaaaacgtaaccctttaccttaccgtttttaccgttaccctaaaaccctaaaagtaaccgaaacgtaccgtaacgttaagggacgggacggggaacggaccgggtaaacggaacccggtacgtaaacggtttacgttaacttaaccggtggtaaggacggaaacgggtacgtacgtaaaccgtaacgtaacgtaacgg

SEQ ID NO: 387310 - DNA, 504 bp, Homo sapiens
  misc_feature: GZ8MTXP02I7RKH.22.86.H09.1.454.CMB.2.raw
  modified_base (327)..(327): a, c, t, g, unknown or other
  modified_base (351)..(351): a, c, t, g, unknown or other
  modified_base (402)..(402): a, c, t, g, unknown or other
  modified_base (497)..(497): a, c, t, g, unknown or other
tcagacatacgcgtcacgaccggtgctcgatttagtgctatagacttgggtttgggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcatggctcccgcaggctccgggnaaggggctggagtggtgcaattanatggtatggatggaataataaagctatgtgactcgtgaaggcgattcacanctcagagacaactccaagaacactctgtttacaccgaaatcgaacagcctagacgaggcgaggacgacggacagtataagttactgtcgagaganacgtacg

SEQ ID NO: 387311 - DNA, 667 bp, Homo sapiens
  misc_feature: GZ8MTXP02FMKV9.22.86.H09.1.454.CMB.2.raw
  modified_base (347)..(347): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagccgtgggaggtccctgagactctcctgtgcagcgtctggattcaccttcagtggctatggcatgcactggcctccgccaggcctccgggcgaaggggctgggagtggggtggactaaagtttanagtgggtatggaagtagggaaaagttaaataaggacttagtggtacggtaaccgtccgggtagggaaacggggcccgtatttacccaacccaagttcccttccccgaaggaaccggaaaccctaaaaccgttaccccgaaaaacgtaaacctaacctttacccgttacgtttttaccctaacccaaaagttacgaaaaccgaccgtaccgtaggacggaacgggccggagggaaccgaacgggctaggtgttaaacgttacgtaggtcgacgaaggagaacgtacggaactagtacggtaacggtaacgggaaagtttcg

SEQ ID NO: 387312 - DNA, 641 bp, Homo sapiens
  misc_feature: GZ8MTXP02GBC37.22.86.H09.1.454.CMB.2.raw
  modified_base (367)..(367): a, c, t, g, unknown or other
  modified_base (603)..(603): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtcgcagcgtctggacttccacttcagtcgctagtggcatcgctacgtggcctccggccgacgggccgtcccggggagaagggggtctaggggacggtggggtacgaccctaaagtttntaaggtggtactggaagttaggggaaacgttaaataaaacgagttaagtgggtacggtacttaccggtaggtaaacggggcccgtattaccaaccgtactccgtaccaagacgaacctaaacgtaccaaagtaaacctacttacttaccgtttactaaacccgtaaagtacggaaactacggtaccaggaacggacggaccggaagacccgaaggccgtagtagttacttaacggngtagaacgacgagtaccgacgaactacgtacgaaacgg

SEQ ID NO: 387313 - DNA, 574 bp, Homo sapiens
  misc_feature: GZ8MTXP02ICI17.22.86.H09.1.454.CMB.2.raw
  modified_base (317)..(317): a, c, t, g, unknown or other
  modified_base (385)..(385): a, c, t, g, unknown or other
  modified_base (403)..(403): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggggcaaggggctgggaggtgggtggcaaattatagtggtatgataggaaagtaaataaacgatagtgtgactccgtagaacggcatcacatcncagagacaactcaaagacactctacgttctacgaaatgaaacagacctgagaggcgagacacgcagtntatacgtgtagacgaganatacgacatgaaacgtaacgggaaagtcgttttagacgtcgtacggtaggggacccaaagggaccaacgttcggtaccaccggttactcttccgacgtcccaccaaccgaaacgggcccaacgttccggttccctccccgtcgggcctcccgtcggcctaccgacgacccg

SEQ ID NO: 387314 - DNA, 657 bp, Homo sapiens
  misc_feature: GZ8MTXP02JY3CR.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattccaccttcagtggctagtggcatgcacgtggcctcccgccgaggcccgtccggggacgaagggggctaggggaggtggggtgacctaaagtttatagtggtatgaataggggaaactaaagtaaaagcttagtggtcggactccggtaggaacggcccgattcccgacctatcctaccgagaacgaccaaacctaccaaacgtaacctacttacgtttacgtttacctaacccgtaaaatcggaaaaccgacggtacccgtaggaaacggggacgggacggaaaacgggaacccgaacggggcctaaagggtttacgttaaacgtttaaccggtgggtacggaacggtaaacggaacgtacgttaccgaacgtaacggtacggtaaaacccggg

SEQ ID NO: 387315 - DNA, 555 bp, Homo sapiens
  misc_feature: GZ8MTXP02HXQNL.22.86.H09.1.454.CMB.2.raw
  modified_base (227)..(227): a, c, t, g, unknown or other
  modified_base (252)..(252): a, c, t, g, unknown or other
  modified_base (321)..(321): a, c, t, g, unknown or other
  modified_base (373)..(373): a, c, t, g, unknown or other
  modified_base (377)..(377): a, c, t, g, unknown or other
  modified_base (389)..(389): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgcaggctccgggnaaggggctggagtgggtgctaattntatggtatgatagggaaataaataaagactatgtggactcgtagaacggccgtatcacatctaccaganacaactccaagaaccatctgtttcaccaaatgaacagctgagagcgaggacncganagtgtattacgngtgacgagtagatcgacagtagaacgtaaacggaaagtcttttagactcgtcgtacgggacaagggcaacgtgtaccacgtctcgttacacgtccctaccaaccgaacggccctacgtcccggttcctcccccgtgcccgtacccgtcgacccgtaccacggaccc

SEQ ID NO: 387316 - DNA, 642 bp, Homo sapiens
  misc_feature: GZ8MTXP02I3YKD.22.86.H09.1.454.CMB.2.raw
  modified_base (529)..(529): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtggctagtggcatgcactggcctccgccgaggccgtccggggcaaggggctgggaggtggggtggcctaaagttatagtggtatagagtgggaaagttaaataaaggacttaagtggtagggtaccttccgtaggaaaggggcccgtaagtttaccgacccgtattcccgtacccaaggaacgaacctaaacctacccgaaaacgaacctaaccttccgttacggttttacccttaaccgaaaacttacgaaaacncggtaacccttaggaacggaacggggcggaaacgggacgaaccgggcgaacggttcggttaaattacgtggttacgaacggaagaggactacggacctaagtacggtaaacgg

SEQ ID NO: 387317 - DNA, 606 bp, Homo sapiens
  misc_feature: GZ8MTXP02GY7I0.22.86.H09.1.454.CMB.2.raw
  modified_base (228)..(228): a, c, t, g, unknown or other
  modified_base (386)..(386): a, c, t, g, unknown or other
  modified_base (393)..(393): a, c, t, g, unknown or other
  modified_base (572)..(572): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggnaaggggctggagtgggtgcaattatatggtatgataggaagtaaataaagactatgtgactccgtggaacggccgattcaaccatctccagagacaactacaaagaacactctcgtttacacaaatagaacacgctgagaggacgagacacggcagtntattacngtgcgaagagatacgaactagtacgaacgttaaacggggaaatttccgtttaagatcgtacgggtagggggaacccgaaaggggacctaacggtggtacccacccgttactccgttaaccgaccgtcccctacccgaaaccggaaccgggccctacgtccccggttccccttcccccgnggccccgtccccgtcgaccgtcccgaaaggcccg

SEQ ID NO: 387318 - DNA, 666 bp, Homo sapiens
  misc_feature: GZ8MTXP02JB5L1.22.86.H09.1.454.CMB.2.raw
  modified_base (188)..(188): a, c, t, g, unknown or other
  modified_base (225)..(225): a, c, t, g, unknown or other
  modified_base (271)..(271): a, c, t, g, unknown or other
  modified_base (274)..(274): a, c, t, g, unknown or other
  modified_base (290)..(290): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctgcctccgtgtctggatcatctggacagtcgatcagcatttccngcactgggaccaacagtgacattgggtcttttgactntgtctcctggtaccaacacacccagccaaacccccatcatcattangtntcactcgtcggccctnaggatctctcatcgcttctcaggctccagtctcggcaacgacggccctaccctaaccatcctcgtcggggtcctaccgtagttttcggaacgggtacgtaacgttccttaactttacttaactgtaccgttagtttacccttttaaaagttaccgggtcctaccctaacgtttccgttcgggtttcggggtttttacccgggcgggtaacgggccgtaaacccgggaacggttccggtaacccggttccgtcggggttaccacggaccccgaaagggtcctacccggccccgttcgggtacctacttcccgttaccggttcccccacccttcccgtccgtaaccgggtccttacgttcggtcgtacggtaccgggg

SEQ ID NO: 387319 - DNA, 577 bp, Homo sapiens
  misc_feature: GZ8MTXP02GWQTP.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcaccttcagtggctatggcatgcactggcctccgccaggcctcccggggcgaaggggctggggaggtcggggtggacctaaagtttatagtgggttatcggaatggggtaaataaactaaaagtctaagtgtaggactccgtgaaacgggtcgattcaaccctatctacagagacaactaccaaagaactacgtctacgttacaccaaagtcgaaactcgaccgtgaagacggacgaacggacacgggcaaggtacgttaagttaacgtcgtagaacgaacggaggtactacggacctaagtacgtaaaccgg

SEQ ID NO: 387320 - DNA, 576 bp, Homo sapiens
  misc_feature: GZ8MTXP02GRGBI.22.86.H09.1.454.CMB.2.raw
  modified_base (361)..(361): a, c, t, g, unknown or other
  modified_base (553)..(553): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggctccggggcaaggggctggggagtggggtggctaaattntagtgggtatggagtagggaaagttaaataaagactaagtgtaggactccggtaggaaggggacccgtagttccaaccgtatacctaccaagtacgaaccaactaccaaagaacaccgttctcgtttactaccctaaaatcgaacacgtcctaggacgaggacggaggacgacggacagtacgtaagttacnggtcgacggacggtagacgtacg

SEQ ID NO: 387321 - DNA, 608 bp, Homo sapiens
  misc_feature: GZ8MTXP02HZB5V.22.86.H09.1.454.CMB.2.raw
  modified_base (188)..(188): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcactggctccgccaggctcccgggcaaggggctgggaggtgggtggcaattatatggtatgataggaaagtaaataaagactatgtaggactccgtggaagggccgattccaccatctaccagagacaactaccaaagaaacactctacgtttacctaccaaatacgaacagcctggagaggcgaggacacggctagtgtattacgtgtgacgagagactcgaacagtacgaaacgtaacggggtaaattcgttttgaacttcgtcgggtacggggaccgaaagggactacgtggtacctccgtcttcttacgacgtcccctaccaaccgtaccgggacccctaacgttcccggtccccttcccccggtccggccgtccccctaggtcccctacgaacgggcccg

SEQ ID NO: 387322 - DNA, 688 bp, Homo sapiens
  misc_feature: GZ8MTXP02G164Q.22.86.H09.1.454.CMB.2.raw
  modified_base (156)..(156): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagccgtgggacggtccctgagactctcctgtgcagcgtcgtggacttccaccttcgagtggctagtcggctatcgacgtacgtcggcctcccggccgacgggtcccgtcccggggacgaacgggggtcgtaggggtaggtggggtcgacctaaagtttagtagtaggttagtaggaagttaagggggtaaacttaaaagtaaaacgtataggtacggtacgggtacgtacccggtaggaaacggggtacctacgttacaccctaagtcccgtaccgaagaaacaacccgaactaaaccgaaacgtaaactacctttacgtcgtttaaccaacaaactacgaacctagtccgtaagggaacggacgggaacggaacggacccggaaggtacgtacggtttagtaacgttaacgttcggaagaaccggtaagtaccgataccggtaactaggtaacggtaaaacccggg

SEQ ID NO: 387323 - DNA, 605 bp, Homo sapiens
  misc_feature: GZ8MTXP02IP3AM.22.86.H09.1.454.CMB.2.raw
  modified_base (329)..(329): a, c, t, g, unknown or other
  modified_base (350)..(350): a, c, t, g, unknown or other
  modified_base (357)..(357): a, c, t, g, unknown or other
  modified_base (359)..(359): a, c, t, g, unknown or other
  modified_base (379)..(379): a, c, t, g, unknown or other
  modified_base (395)..(395): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggatgatggaagtaataaagactatgtgactccgtgaaggccgattcaccatctccagagacaatcccgaaaanactactctacttaccacaaanacaacancngagacggacgagacacgganagtgtatacgtgacgngaagtagacgtacgaacaagtacgaacgtaaacggtaaacgttacgtttacgttacgtacgtacggtacgggaccggaacggaacgtacgtacgtaccgtaccgtacgttaccttacgtacgtaccctacccgaaccgaaaccggacccgtaccgttacccgttcccgttccccgtcccgtcccgtcccgtccgtccgtaccgacggacg

SEQ ID NO: 387324 - DNA, 534 bp, Homo sapiens
  misc_feature: GZ8MTXP02I6CQX.22.86.H09.1.454.CMB.2.raw
  modified_base (241)..(241): a, c, t, g, unknown or other
  modified_base (354)..(354): a, c, t, g, unknown or other
  modified_base (375)..(375): a, c, t, g, unknown or other
  modified_base (382)..(382): a, c, t, g, unknown or other
  modified_base (391)..(391): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctctggtaccaangcacccaggcaaagcccccagactcatcatttatgctgtcaataagcggccctcgaggggtccctgatcgcttctctcggctccaagtctcggcaacacggcctcctcgaccntctctggcctccagctgacgntgaggtnacttttacngtctgctcatatgcaggcaactatatagtgtctcgggcggtaaggacctaaagtcgtaccgtacgtagggttacacggacccaacgggtcctcccgtcccgtcggtaacctcctcgttcccgtacccctcctccgtactaccg

SEQ ID NO: 387325 - DNA, 614 bp, Homo sapiens
  misc_feature: GZ8MTXP02JECNQ.22.86.H09.1.454.CMB.2.raw
  modified_base (278)..(278): a, c, t, g, unknown or other
  modified_base (395)..(395): a, c, t, g, unknown or other
  modified_base (428)..(428): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatagataggaagttaaanaaggactatgtaggactccgtggaggcgattcacatctccagacgacaactaccaagaacactctcgttaccacaaatacgaacagcctaggacgacgggcggaacgacgaccgggntagtagtattactgtgacgtaagagacacgaanagtacgacgtaacggggtaaatctttagattaccgtcggtacggggaccgtaaagggactaacgtcgggtacctaaccggttctacttaccgacgttccctaccgaaccgtaacgggcccctaacgttcccggttacccctttcccccgcggttacccgcccgttcgaccgtcccgagggtacccg

SEQ ID NO: 387326 - DNA, 622 bp, Homo sapiens
  misc_feature: GZ8MTXP02GAZ3F.22.86.H09.1.454.CMB.2.raw
  modified_base (226)..(226): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggnaaggggctgggagtgggtggactaattatagtggtatgatggaaataataaagatatgtggactcgtgaaggcgatcacatctcagagacaactacaaagacactctacgtttcacaatgaacagctgagaggacgagacgacggctagtacgtattacgtgtacgacgaagagtatacgacgtaatacggaaacgttaaaggggtaaacttcgttttacggaacttccgtacgggtacgggggaaccctaaaggggacctacgtcgggtacctaccgttctaccgttacgacggtccctaacccgaaaccggtaaacgggcccccttacggttccccggttacccttcccccggcggtcccgtccccgtacggccccttacggacgggtaccccg

SEQ ID NO: 387327 - DNA, 616 bp, Homo sapiens
  misc_feature: GZ8MTXP02FO0RH.22.86.H09.1.454.CMB.2.raw
  modified_base (414)..(414): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccagccgtgggaggtccctgagactctcctgtgcagcgtctggattcaccttcagtggctatggcatgcacgtggcctcccgccgaggccgtcccggggcgaagggggtctggggaggtggggtggacctaattatagtggtatgaatgggaaataataaagatagtgtggactcgtagaaggcgatcactancctcaagagaccaactaccaaacgaaacctacttacttcgtttacctaacccaaaagttacgaaacgtacgaccttagggaaacggaacggggacccggaaaggggaacccgaaccggggacgtaaacggttaggttaacttaacggtcggttaggaacggtaaagagggtactaccggaactacgtacggtaaaaccgggg

SEQ ID NO: 387328 - DNA, 569 bp, Homo sapiens
  misc_feature: GZ8MTXP02GAL8I.22.86.H09.1.454.CMB.2.raw
  modified_base (526)..(526): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggctccgccaggcctccggggcaaggggctgggaggttggggtggactaaagtttagtagtgggtatggaattagggaaaagttaaataagactagtgtagggacctcggtaggaaacgggccgattcaccatcctaccagagaacaactaccaaagaaccacttctagtttacctaccaaatacgaaacacgcctagaagacggcgaaggacacggactagtgtattacgngtcgacgagagaatacgacagtagaacgtaacggggtaattcg

SEQ ID NO: 387329 - DNA, 653 bp, Homo sapiens
  misc_feature: GZ8MTXP02IWQEY.22.86.H09.1.454.CMB.2.raw
  modified_base (325)..(325): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctgacgactctcctgtcgcagcgtctggattcaccttcagtggctagtggcatgcactggcctcccgccgagggccgtcccggggngaaggggtcgtggggaggtggggtgacctaaagttagtagtagggtatggaatagggaaataaaagtaaacgtatagtggtaggacctacggtaggaacggtaccgtagttacaaccctacttccaccgaagaacgaaaccaacctaaccgaaacgtaaacctacctttacttacgtttacctaaccaaaatacgaaacacgacctaggaaggacgggaacggaacggaaccgaacggggtaccgtaaacggttacggttaacgttaaccgtgggtacggaacggtaaaggaacgtacgtacgaacgtaacgtaaggtaaaaccgggg

SEQ ID NO: 387330 - DNA, 594 bp, Homo sapiens
  misc_feature: GZ8MTXP02I1ARZ.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagcctgggagtccctgagctctcctgtgcagcgtctggattccaccttcaggtggctagtggcatgccacgtcggcctaccgccgagggccgtcccggggagaacggggctaggggaggtggggtgacctaagttatagtcggtatggaataggggaaataaacgtaaagactagtggtacggactccggtaggaacgggcctagttaccacgtatcctacagaacgacaactaccgaaacgtaacacttcttacgttaccacctaaaatcgaaacacgaccgtgaacggaggacggacggacgacggacgtaggttacgttagtaacgtgtacggaagaggagacgtaccgaacttagacgtaaaccggg

SEQ ID NO: 387331 - DNA, 631 bp, Homo sapiens
  misc_feature: GZ8MTXP02FTH3S.22.86.H09.1.454.CMB.2.raw
  modified_base (258)..(258): a, c, t, g, unknown or other
  modified_base (316)..(316): a, c, t, g, unknown or other
  modified_base (346)..(346): a, c, t, g, unknown or other
  modified_base (386)..(386): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagctctcctgtgcagcgtcnggtattccaccttcagtggctatggcatgcactggcctccggccaggcctcccggggnaagggggctgggagtggggtgcaagtttanagtggtatggaactggggaaataactaaaagactagtagnggtacctacggtagaacggccgtattcaaccctatcctaccgaagacgaaaccaaactaccgaaacgaaacctaccttacttacgtttaccctaaccaaacgtacgaaacacgtaccgtaggaacgggacgaccggtaaagggaccgaacgggtaccgtaacggtttacggttaacgtttaaccgtggttaaccggaacgtaaaggtaacgaacgttaccggaaactaccggtaagtaaaccggg

SEQ ID NO: 387332 - DNA, 690 bp, Homo sapiens
  misc_feature: GZ8MTXP02G93E0.22.86.H09.1.454.CMB.2.raw
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagcttgggttttcctcgttgcttcttttaagaggtgtccagtgtcaggtgcagcgtggtggagtcgtgggggaggcggtggtccaggccgtgggacggtccctgacgactctcctgtgcagtcgtctggacttcaccttcgagtggctagtggcagtcgcctacgtcggcctcccgccgacgggcccgtacccggggacgaacggggtcgtaggggtaggtcggggtagaccgtaagtttagtagttaggtatagaaggtagggtaaagttaaagtaaacgtagttagtgggtacggtacccgtaccgggtaggaaaccgggtccgtaacgttccaacccgtaacttcccgtaaccgaagaaccgtaaaccaaacccaaaccggtaaaactaaaccgtactttcgtttacgtttaccgtaaccaaaagttacgaaacgacgtaccgaaggaacgggacggacggaacggaccgacggaacgtaggttagttaccgtacgtcggtacggaaggtaacgaagacgtacgacgtaagtacggtaaaccggg

SEQ ID NO: 387333 - DNA, 523 bp, Homo sapiens
  misc_feature: GZ8MTXP02IGGT6.22.86.H09.1.454.CMB.2.raw
  modified_base (417)..(417): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctcgtttctccaaatgaacagcctgagaggcgagacacggcagtgtattactgtgcgagagatcgacatgactagggaaatntttgatctcgtggggaccaagggcacgtggtcaccgtctcttcacgcctccaaccgacgggcccagtccggtcctcccccgtggccgtccctgcctccgacggacg

SEQ ID NO: 387334 - DNA, 639 bp, Homo sapiens
  misc_feature: GZ8MTXP02GIC5G.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctgggaggtgggtggcaattatatggtatgataggaaagtaaataaagactatgtggactccgaggaaggccgatcacatctaccagagacaactaccaaagaacactctacgtttactaccaaaatgaaacacgcctggaagacggacggagggacaacgggtacaaggttgttaactttaacgtggtaggacgaagagactacgaacagtacgaaacgtaaacggggaaagttctttagatcgtacgggtacggggacccgaaaggggtaccaacgttcggtacctacccgttcttccttacgacgtaccctacccgaacccgaaacggggccccctaacgttccccgggttccccttccccccggtcgggcccgtccccgtgtcccctaccggacggaaccg

SEQ ID NO: 387335 - DNA, 629 bp, Homo sapiens
  misc_feature: GZ8MTXP02JSIYC.22.86.H09.1.454.CMB.2.raw
  modified_base (351)..(351): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatggtggactccgtagaaggcatcaccatctcagacgacaactacaagaacactcttcgtttacaccaaatnaacagcctgaaggaggcgaggacacggacagtagtattacgtgtgacgagagatcggacagtacgaacgtaaacgggaaacgttcgttttagaacgttcgtaccgggtacggggtacccaaaggggtaaaccctaacgttcggtaccctacccggttactccgtttacccgacggtaccccttcccgaaacccgaaaccggggtcccctaacgttcccgggtcccctttcccccggcggtacccgtccccctacggtcccctaccggaacggtacccg

SEQ ID NO: 387336 - DNA, 558 bp, Homo sapiens
  misc_feature: GZ8MTXP02FNTKY.22.86.H09.1.454.CMB.2.raw
  modified_base (225)..(225): a, c, t, g, unknown or other
  modified_base (242)..(242): a, c, t, g, unknown or other
  modified_base (286)..(286): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccagcagtgatgttggtgttataactntgtctcctggtaccaanagcaccaggcaagccccagactcatcatttatgctgtcaataancggccctcgaggggtcccctgatcgcttctctggcctcaagttctcggcaacacggccctccctcgacccatcctacttggggcctcccaggccttgaaacgatgagcgtgattattacctgctgcttctagtttgcgtaggccgcccttacgacgtttcggggtgttccggcggacgggaccaaggcctaggaacccgtcgtacggtcacggcccaggccgtcgtcccccgcggttcaccggttcctccgttaccccgccctccgtacccg

SEQ ID NO: 387337 - DNA, 560 bp, Homo sapiens
  misc_feature: GZ8MTXP02FXU3Y.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagctctcctgtgcagcgtctggattcaccttcagtggctatggcatgcactggctccgcaggctccgaggcgaaggggctgggagtggggtcgactaattatagtggtatgagtagggaaagtaaataaagacttagtggtacggacttccggtaggaacggggaccgtattaccgaccactctaccgagacgaaccaaacgtacccaaagtaaccacttccttagtttaccaccctaaatacgaactagccctaggacgaggacggaggacgacgggcagtgttaacttacgtggtaagcgaagagactcgaacataacgg

SEQ ID NO: 387338 - DNA, 614 bp, Homo sapiens
  misc_feature: GZ8MTXP02HOZ8V.22.86.H09.1.454.CMB.2.raw
  modified_base (312)..(312): a, c, t, g, unknown or other
  modified_base (346)..(346): a, c, t, g, unknown or other
  modified_base (515)..(515): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattccaccttcagtgctatggcatgcactggcctccgcaggcgtcccgggngaaggggctgggagtcggggtgaccctaaagttntagtggttactggaattgggaaaagttaaataaaggacttaagtggtacggtaccgtccgtaggaacgggtccgtattacccgaacctatccctaaccaaggaacgacaaaccgtacccaaagtaaacctacttacgtttacgtttaccaacctaaagttacgaaaccncgtaccgtaggaacgtaggggacgacggacggacggactagggttctaaacgttcgtaggtagaacggaagacgtactcgactacgtaacggtaaccgg

SEQ ID NO: 387339 - DNA, 633 bp, Homo sapiens
  misc_feature: GZ8MTXP02G5KPQ.22.86.H09.1.454.CMB.2.raw
  modified_base (226)..(226): a, c, t, g, unknown or other
  modified_base (388)..(388): a, c, t, g, unknown or other
  modified_base (445)..(445): a, c, t, g, unknown or other
tcagacatacgcgtcacgaccggtgctcgatttagtgctatagacttgggtttgggctgagctgggttttcctcattgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctggagtggggtggctaattatagtggtatgaatggaaataataaagcttaatggtaggactccggtaggaacggggccgattcaaccatcctccaagacgaaccaaacctaccaaagaaacctactccttagtttacctaccaaaattgaaaccngcctggaacgaggcgaggacagggctagtcgtattacgtgtagcgagagataccganagtagtaaacgtaacgggtaaaacgttcgttttagacttcgtacgtacggggaccgaaacgggactaacgtggtcccgtaacgttccttacgttacgaaccgtccctacccgaaaccgaaaccggggtccctaacgttcccggtccgtttcccccgcgggcccctccgtccgacccgttacgaaccgg

SEQ ID NO: 387340 - DNA, 569 bp, Homo sapiens
  misc_feature: GZ8MTXP02JPPZA.22.86.H09.1.454.CMB.2.raw
  modified_base (280)..(280): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcacttcagtggctanggcatgcatcggcctcccgcaggcctccggggcgaaggggctgggaggtggggtgactaattatagtggtatgagttaggaaagttaataagctaagtgtacgcgtacgtaggaacgggccgtattaccactactctacccgagacgaacaactaccaagaacctactcttacgtttaccacgaaatcgaaacagcctaggacgaggacgaacggacgcggacaggtgtaaacgtcgtagacgtacgaagtacgaagtacgacacgtacgtaacgtaacggtaatttcg

SEQ ID NO: 387341 - DNA, 617 bp, Homo sapiens
  misc_feature: GZ8MTXP02FT4E0.22.86.H09.1.454.CMB.2.raw
  modified_base (513)..(513): a, c, t, g, unknown or other
  modified_base (575)..(575): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcgtctggattcaccttcagtggctagtggcatgcacgtggcctcccgccgaggccgtcccggggcgaaggggtctggggaggtggggtgacctaagtttatagtggtataggaagtagggaaagtaaagtaaagacttagtggtacggactccggtagaacgggccgtacttccacctactcctaccgaagaacgaaccaacctaccgaaaacgtaacctaaccttcttacgtttacctaacctaaaagtcgaaaacncggtacctagggaacgacgggacggaacgggaccgacggcgtaaaggtcgttaacgttacgngtacggaacgagagtaacgtacgaactagtacggtaaaccgg

SEQ ID NO: 387342 - DNA, 542 bp, Homo sapiens
  misc_feature: GZ8MTXP02HCXRA.22.86.H09.1.454.CMB.2.raw
  modified_base (317)..(317): a, c, t, g, unknown or other
  modified_base (518)..(518): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcaggcgtctggattcaccttcagtggctatggcatgcactggctccgccaggccgtcccggggnaagggggctggggaggtggggtggcctaattatagtgggtatggagttgggaaagttaaataaagactagtgtgggaaccgtcgtagaacgggccgattccaccatcctcagacgacactaccaagaaccactactgtttactaccaaatcgaaacagcctgagaggacgaggacacgggacaggtacgtattacgtgagngagagactacgacagtagaaacgg

SEQ ID NO: 387343 - DNA, 606 bp, Homo sapiens
  misc_feature: GZ8MTXP02GNRZZ.22.86.H09.1.454.CMB.2.raw
  modified_base (262)..(262): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggtccagccgtgggacgtccctgagactctcctgtgcagcgtcnggattccaccttcagtggctatggcatgcacgtggctcccgcaggctcccggggcgaaggggctgggaggtggggtgacctaattagtatgggtatggaattaggggaaaataaaacgtaaagtactagttaggacggtacctaccgggtaggaaacggggcccgtaataccgaactacgtcctacgagaacgaaccaacgtaaccaaagaacacttcgtacgtttacctaccaaaatcgaaacacgaccgtagaacggaggacgacgggaaccgacgggacgtaggtagttacgttacgtaggtagaacggaagagtactacgaactagtacgtaaaaccggg

SEQ ID NO: 387344 - DNA, 697 bp, Homo sapiens
  misc_feature: GZ8MTXP02HI2WD.22.86.H09.1.454.CMB.2.raw
  modified_base (282)..(282): a, c, t, g, unknown or other
  modified_base (321)..(321): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcctccgggcgaaggggctgggaggtgggtggactaattatagtggtatgataggaaataaanaaagactagtgtcggactcggtagaacggcctatccacntctaccaagacaacactacaaagacactctacgttacaccaaatacgaacacgctaggacggacggacggagaccgtaggctagtagttacttacgtgtagacggtaagagtactacgaacgtaagtacgaaccgtaaaggggtaaacttcgttttacgtaacgttccggtacgggtacgggggaacccgtaaaacggggaccgttaaccgttcggggttaccctaacccgtttccttacccgttttaccgacccgtacccccgttaacccgaaacccggtaacccggtacccggttacccgttcccccggtttaccccgttccccccggtcggtccccgtccccgttaccggcccgttaccggaacggtaccccg

SEQ ID NO: 387345 - DNA, 608 bp, Homo sapiens
  misc_feature: GZ8MTXP02F3KMK.22.86.H09.1.454.CMB.2.raw
  modified_base (262)..(262): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggaggtccctgagactctcctgtgcagcgtcnggattcaccttcagtggctagtggcatgcactggcctcccggccagggccgtcccggggcgaagggggctggggaggttggggtggcctaaagtttgtagtgggttatgaagttgggaaagttaaataaaggactagtggtcggacgtccgtaggaacgggccgaattccaccatcctacaagacgaacaactaccaaagaacctactcttacgtttaccacctaaaactacgaaacacggtcctaggaagacggggacggaacgggaccgacgggctaaggtacgttaacttaccgtggtaccggaaggaacgagttaacgcggaaccagttacggtaaaccggg

SEQ ID NO: 387346 - DNA, 782 bp, Homo sapiens
  misc_feature: GZ8MTXP02GTNNE.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagccgtgggaggtccctgagactctcctgtgcagcgtctggattcaccttcagtggctagtggcatgcactggcctccgccgaggccgtccggggacgaagggggctggggaggtgggtggactaattagtagttggtataggaagtagggaaaagtaaagtaaaagacttagtggtacggactaccggtaggaaacggccgtacttacaacctatacctaccgaaagaacgaaacctaaacctaccgaaaacgaaacctacttacttaccgtttacctaaccaaaatacgaaactacgcctaggaacggacggacggaacggaccgacggactaaggttacttaaattacgtggtagacgaagagacgtaacgaacgtataacggtaaaccggttaaaacgggggtaaatttcgtttttaaggaacgtttccggtaacggggacgggggaaacccgaaaggggtacccctaacgttcgggtaccccaacccggtttctaccgtttaccgaacccggtcccctaaccccggaaaacccggtaaaccggggtcccccttaacgggttcccccgggtttcccctttaaccccccggcggggtccccctaccccgttcggaccctacccgggaaacggggccccg

SEQ ID NO: 387347 - DNA, 681 bp, Homo sapiens
  misc_feature: GZ8MTXP02JVC6I.22.86.H09.1.454.CMB.2.raw
  modified_base (192)..(192): a, c, t, g, unknown or other
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagcttgggttttcctcgttgcttcttttaagaggtgtccagtgtcaggtncagctggtggagtcgtgggggaggcgtggtccagccgtgggacgtccctgagctctcctgtgcagcgtctggattcacctcagtggctagtggcatgcactggcctcccgccgaggccgtcccggggcgaaggggctggggaggtggggtgacctaagttagtagtggtatggagtagggaaattaaagtaaagacgtaagtggtacggacccgttaccggtaagggtaaacgggtccctaacgttaccaacccgtacgttcccgtaccgaaagaaccgaacctaaaccgtacccgaaagaaaccctaccgtttacttaccggttttacccaaacccgtaaaagttaccgaaaacctacggtacccgtaggaacggacgggacggaaacgggaccgaaacgggccgttaaggtacgtttaacgttaccgttaggtaccgggtaacgaagtaacggttacgacggaaccgtaggtaacggtaaaaccggg

SEQ ID NO: 387348 - DNA, 594 bp, Homo sapiens
  misc_feature: GZ8MTXP02JI1CH.22.86.H09.1.454.CMB.2.raw
  modified_base (280)..(280): a, c, t, g, unknown or other
  modified_base (337)..(337): a, c, t, g, unknown or other
  modified_base (399)..(399): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtcnggactcaccttcagtggctatggcatgcacgtggcctcccgcgaggccgtccggggngaaggggtctggggaggtggggtagactaagttatacgtggtatggaagtaggaaagtaaanaaagactaagtggtaggacgtcggtaggaacgggtcgtactacgaacctactactaccgaagaacgaaaccaactaccgaaacgaacctacgtcttacgttactaacaaacgtacgaaacacgtaccgtagaaggacggacgaggacgaccggacgtacgtagtaacgtacgtcgtagacgtaacgagacgtacg

SEQ ID NO: 387349 - DNA, 610 bp, Homo sapiens
  misc_feature: GZ8MTXP02FRNQ8.22.86.H09.1.454.CMB.2.raw
  modified_base (463)..(463): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagctctcctgtgcagcgtctggattcaccttcgagtggctagtggacatgcacgtggcctcccgcgacggccgtccggggacgaacggggctggggaggtggggtgacctaagttatagtggtatggagtagggaaataaataaagactagtggtaggactccggtaggaacgggccgtattcaacctactccgtaccgaagacgaaaccaacgtaccgaaanaacctacttcttacgtttacctaacctaaagtacgaaactacgtaccgtaggaaggacggaccggaacggaccgacggtacgtaaggttagttaacgttacgtggtacgaacggaagacgtacgtacgaagtacggtacgtaaacgg

SEQ ID NO: 387350 - DNA, 647 bp, Homo sapiens
  misc_feature: GZ8MTXP02GWSLB.22.86.H09.1.454.CMB.2.raw
  modified_base (277)..(277): a, c, t, g, unknown or other
  modified_base (428)..(428): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcgaaggggctgggagtgggtggactaattatatggtatgataggaagtaanaaagactatgtaggactccggtaggaagggccgtattcaccatctaccagagaacaactaccaaagaaccactctacgtttacaccaaatgaactagcctggacgaggcgaaggacacggctagtgtattacgtgtgacgagagatacganagtagaacgtaacgggaaagttcttttagattccgtacgggtacggggaccgtaaaggggacctacgtacgggtaccctaccggttctaccgttacgacccgtccccgtacccgaaacccggtaaccggggtcccctacggttccccgggtacccctttcccccggccgggtccccgtcccccgttacggccccgttacccggaacggggtaacccccg

SEQ ID NO: 387351 - DNA, 555 bp, Homo sapiens
  misc_feature: GZ8MTXP02FWAE7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgacaattatatggtatgatggaaagtaataaagactatgtggactcgtgaaggccgattcacatctccagagacaactccaaagaacactctcgtttctaccaaatgaacagcctgagaggacgagacacggcagtgtattactgtgcgagagatcgaacatagactaacgggaaagtcttttagattctcgtggggacccaaggggacacgtgtcaccgtctcttcacgccctaccaaccgaaacgggcccctaacgtccggttaccccttcccccgtgggcccgccccgtcgacctcccgacggtaccg

SEQ ID NO: 387352 - DNA, 746 bp, Homo sapiens
  misc_feature: GZ8MTXP02IJ6LM.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggagtccctgagactctcctgtgcagcgtctggattccaccttgagtggctatggcatgctacgtggacctccgcgacggtccgtccggggacgaaggggtcgtagggtaggtgggtacgataaagttagtagtggtaatgaataggtaaaagtaaataaagtactagtggtcgacgtaccggtaaggacggtacctataccacatccgtacgaaggaactaaccaaaaccgtacaaaagtactaactcttaccgttaccaaaccgtaatacgaactaacgccgaggaacgacgggaccgaggtaacccgagtacgtagtagtttaaacgacgtggagaaggaagtaacgacgtaacgaacgtaagtaacgtaaaacggttaacggttaaagttcgtttacgtacgtccgggtacgggtaaccgggaaccgtaaacggacctacggtccgtaacccgtaccgtttactacccgtaccacccgtaccccgtaaaccgaaacccggtacccggttacccgtacccggtttaccccgttacccccggttcccggtacccgaccccggttacccgtacgtaccccggtaaacggaccgtaacccg

SEQ ID NO: 387353 - DNA, 707 bp, Homo sapiens
  misc_feature: GZ8MTXP02GOS7G.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatcgcactggctcccgccgaggccgtcggggcaaggggctgggagtggggtggctaagttatagtggtatgataggaagtaataaagactagtggtacggtacgtaccggttaggaaacgggggtaccgacgttaccgtaaccctaacgttaccgtaccccgaaaggaaaccggaaacctaaaacccttaacccgaaaacggtaaaaccctacctttaccgtttaccgtttttacccttaaaccctaaaaagtttacggaaaaccctaacggggtaccccttaagggaaacgggtaaacggggacccgggaaaacggggaacccggtaaccggggacctaaggggttaacgtttaaacgtttaccgtaggttacgggaccggtaacggaaggtaacctaacggg

SEQ ID NO: 387354 - DNA, 585 bp, Homo sapiens
  misc_feature: GZ8MTXP02FPCZU.22.86.H09.1.454.CMB.2.raw
  modified_base (311)..(311): a, c, t, g, unknown or other
  modified_base (400)..(400): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactcgtgaaggcgatcacatctcanagacaactccaagaacactctcgtttacaccaaaatgaacagctgagaggcgagacaggcagtgtattactgtgacgagagatcgaacngtagaacgtaaacggggaaattcgttttagattcgtacggtagggggacccaaaggggacctaacgtcgggtaccaccgttctccttacgacgtccctacccgaaaccgaacggggacccctacgttcccggttcccttccccccgtgggcccccgtccccgtcgtacccgaccggacggacccg

SEQ ID NO: 387355 - DNA, 641 bp, Homo sapiens
  misc_feature: GZ8MTXP02GXYYE.22.86.H09.1.454.CMB.2.raw
  modified_base (252)..(252): a, c, t, g, unknown or other
  modified_base (349)..(349): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtggcaattanatggtatgatggaaagtaataaagactatgtagactccgtagaaggccgatcaccatctcagacgacaactcaaagaacactctgttccaccaaatnaacagcctggaacgaggcgagaccgacggcagtgtatactgtcgagtaagagatacgaactagttacggaaccgtaaaaggggtaaacgttactttttaggaatttcccgtaggtacgggggaacccaaaggggacctaacggtcggttaccgaccggtttctaacccgtttcgaccgttacccctacccaaaccgaaaccggggtcccctaaacgttccccgggttaccccttccccccggttggacccccgtaccccgtacgggtccccttaacccgagggtaaccccgg

SEQ ID NO: 387356 - DNA, 553 bp, Homo sapiens
  misc_feature: GZ8MTXP02GU36R.22.86.H09.1.454.CMB.2.raw
  modified_base (226)..(226): a, c, t, g, unknown or other
  modified_base (332)..(332): a, c, t, g, unknown or other
  modified_base (335)..(335): a, c, t, g, unknown or other
  modified_base (346)..(347): a, c, t, g, unknown or other
  modified_base (354)..(354): a, c, t, g, unknown or other
  modified_base (383)..(383): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaaggggctggaggtgggtgactaattatatggtatgagtaggaataataaagactatgtgactcggtagaaggccgtatcacatcctcagagacaactcaaagacnctntcttacacaannaacagcngagaggcgagacacgcagtagtattacgngtgacgagagactcgaacagtagaacgtaacggggaaattcgtttagacgtctcggtacggggaccaaaggggactacgtaggtcctaaccgtctacttcgacgtcctacccgaacgacgggtccctacgtcgttccctccccgtggccgtccctgaccctcgaacgccg

SEQ ID NO: 387357 - DNA, 566 bp, Homo sapiens
  misc_feature: GZ8MTXP02FEXMS.22.86.H09.1.454.CMB.2.raw
  modified_base (340)..(340): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatggtggactccgtaggaaggccgattccaccatctccagagacaactccaagacactntcgtttcaccaaatgaacagcctgagaggcgagacacggcagtgtattactgtgcgagagatacgacagtacgaacgtaaacgggtaaagtacgtttgtatcgtcggtagggaccgaacggacgacgtcgtctaccgtctcttcacgcccaccttttttttaccgaaccggacccgtacgtccgttcccgtcccccgtccggtccgccctcgcctaccgacgaccg

SEQ ID NO: 387358 - DNA, 595 bp, Homo sapiens
  misc_feature: GZ8MTXP02GEAI4.22.86.H09.1.454.CMB.2.raw
  modified_base (322)..(322): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagctctcctgtgcagcgtctggtatcaccttcagtggctagtggacatgctacgtggcctcccgcgaggccgtcccggggngaaggggctggggaggtggggtgacctaagttatagtggtatgagtagggaaataaataaaggactagtagtaggactccgtagaaacggggtccaattccaacctatcctaccgaagacgaaaccaacctaaccgaaagaaacctacctttcgttacgtttaccaaccaaaactacgaaactacggacctaggaagacgggacgaacggacgaccggactaggtacgtattaacgtgtacgaacgagagtactcgaactagtacgtaaacgg

SEQ ID NO: 387359 - DNA, 600 bp, Homo sapiens
  misc_feature: GZ8MTXP02IU2MM.22.86.H09.1.454.CMB.2.raw
  modified_base (271)..(271): a, c, t, g, unknown or other
  modified_base (307)..(307): a, c, t, g, unknown or other
  modified_base (310)..(310): a, c, t, g, unknown or other
  modified_base (325)..(325): a, c, t, g, unknown or other
  modified_base (379)..(379): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaaataanaaagactagtgtggactccgtgaaggcatcacatcncanagacactcaagaacnctcttcttcacaaatgaacagctgagaggacgagacgacgctagtgtaatacgngtgacgtagagtactacgaacgtatacggaaacgtaacggggaaaattcgtttagaagttcctagggtaccggggaacccgtaaaggggcctaacggtcgggttacccaaccggttcttaccgttcaccggtccctacccgaaacggaacggtcccctacgtcccgggttccctaacccccggtgggaccctcccgttcgcccgtaccgtacgggaccccg

SEQ ID NO: 387360 - DNA, 549 bp, Homo sapiens
  misc_feature: GZ8MTXP02G8TX7.22.86.H09.1.454.CMB.2.raw
  modified_base (362)..(362): a, c, t, g, unknown or other
  modified_base (529)..(529): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggccgtccgggcaagggggctgggagtgggtgactaattatagtggtatgataggaaataataaagactatgtgactccgtagaacggcgtatacactatctccagacgacaactacaaagacactctcttctaccaatcgaacngctgagaggcgagacacggacagtagtatacgtgtgacgagtagatcgatagtagacgtaaacgggaattcgtttagatcgtcggtagggaccgtaaggactacgtgacctaccgtctcttacacgcctaccgaccgaacggcctacgtccgtccctcccgtcgccncctcgcctacgacggtaccg

SEQ ID NO: 387361 - DNA, 676 bp, Homo sapiens
  misc_feature: GZ8MTXP02F4X07.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcctgtgcagcgtctggacttcaccttcagtcggctagtggacagtcgcacgtcggcctcccggccgacgggcccgtcccggggacgaacgggggtctggggacggtggggtgacctaagttagtagtggtatggaattaggggaaataaaataaagacttagtggtacggtaaccgttccggtaggaacgggtcctaacgttaccacctactccctacgaacgaacgaaacccaacctaaccaaaacgtaacctacctttaccgttacgtttaacccaacctaaaactacggaaaccacggtaccctagggaacggaacgggaccggaaacgggaacccgacgggtacgtaaaggttacgttaacgttacgtggtacggtaaccggaaggtaacgaacgtaccgaaacgtagtaacggtaaaacccggg

SEQ ID NO: 387362 - DNA, 650 bp, Homo sapiens
  misc_feature: GZ8MTXP02GHT27.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggccgtgggacgtccctgacgactctcctgtgcagcgtctggattcaccttcagtggctagtggcatgcacgtggcctcccgccaggccgtccggggcgaaggggctggggaggtggggtggacctaaagttatagtggtatagaagttaggggaaaagtaaataaaacggtacttagtaggtacgggtaacgttacccggtagggaaaccgggtccgtaacgtttaccaaccgtactcccgttaccgaaagacgaaacctaaacctaaccgaaacgtaaactaccttacgttactttaccaaaccgtaaaactacggaaactacgtaccgtaaggaacggaacgggacggaacgggacccgacggtaccgtagtaggttacttaacgtgtcgaagacgagactacgacgagtacggtaaacggg

SEQ ID NO: 387363 - DNA, 628 bp, Homo sapiens
  misc_feature: GZ8MTXP02FVHF9.22.86.H09.1.454.CMB.2.raw
  modified_base (583)..(583): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgactctcctgtgcagcgtctggattcaccttcagtggctagtggacatgcctacgtcggcctcccgccgagggccgtcccggggcgaaggggcgtagggaggtggggtgacctaagttagtagtgggttataggaagttaggggaaacttaaaagtaaaacgtattagttgggtacggaccttaccgggtaaggaaccgggtcctaattcccgaacctatcctacaaggacaacctaaacctaccaaacgaactactcttacgtttaccaactaaagtcgaacagtccgaggaacggacggacgaacggacaacggtcgtaaagttcgttacgtttaacggnggacgaacgaagtacgtacgtacgactaacggtaacggtaaacgg

SEQ ID NO: 387364 - DNA, 616 bp, Homo sapiens
  misc_feature: GZ8MTXP02GLJC0.22.86.H09.1.454.CMB.2.raw
  modified_base (227)..(227): a, c, t, g, unknown or other
  modified_base (351)..(351): a, c, t, g, unknown or other
  modified_base (387)..(387): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggacaattatatggtatgatggaaagtaataaagactatgtggactcgtgaaggccgatcacatctcagacgacaactccaaagaacactctcgttcacaatgaacngctggagaggcgaggacacggcaggtattattacgngtcgacgaggagagtcgactaatagaacgtaaacggggtaaattcgttttaggactcgtcggtacgggggacccgtaaaggggacctacgttacgggtaccctacccggttcgtaccgttaccgaccggtcccttaccccgaaaccggaacggggtcccctaacgttccccgggttccccttcccccgtcgggccccgtcccgttcgccccgttaccggacggtacccg

SEQ ID NO: 387365 - DNA, 690 bp, Homo sapiens
  misc_feature: GZ8MTXP02FWA3X.22.86.H09.1.454.CMB.2.raw
  modified_base (427)..(427): a, c, t, g, unknown or other
  modified_base (443)..(443): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaaggggctggagtgggtgctaattatagtggtatgataggaaagtaataaagactagtggtaggactccggtaggaacgggcctattccacctatcctaccaaggacgaaccaacctacgaaagaactacttctacgtttaccaccaaaatcgaaacacgacctgggagacgggacgaaacggcctaacgggctaagggttnttaaacgtttaccggnggtacgacgaagtagacgtacgaatacgtaacgtaaacggtaaacgggtaaacggttacgtttacgttacgttacgttacgggtacgggtaaccggaacggtaacgtacgtacggtaccgtaccgtaccgtaccgtaccgtaccgtacccgtacccgtaaacccggtaaccggtacccgtaccgttacccggttaccccgttccccgtcccggtcccgtcccgtaccgtaccgtaccgtacgtaccg

SEQ ID NO: 387366 - DNA, 636 bp, Homo sapiens
  misc_feature: GZ8MTXP02FYR5D.22.86.H09.1.454.CMB.2.raw
  modified_base (264)..(264): a, c, t, g, unknown or other
  modified_base (277)..(277): a, c, t, g, unknown or other
  modified_base (364)..(364): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggacgtccctgagacctctcctgtgcagcgtcnggacttcaccttnagtgctagtgcatgcacgtgcctccgccgaggcctccgggcgaaggggtctggggaggtggggtgacctaagttatagtcgggttanggtaagtaggggaaaattaaaacgtaaaagtacctaagttagggtacgggtaccttaccggggtaggaaacggggtacccgtaacttcccaaccgtaatccctaaccgaagaacgaaaccaaacctaaccgaaacgaaactaccttcgttactttaccaacctaaaacgtgaaaccacggtacctaggaacgtaacgggcgaacggaaccgacggacgtagttacgtagttaacgtgtagaacgaagacgacgtacacgagtacgtaaacgg

SEQ ID NO: 387367 - DNA, 575 bp, Homo sapiens
  misc_feature: GZ8MTXP02GM0U2.22.86.H09.1.454.CMB.2.raw
  modified_base (288)..(288): a, c, t, g, unknown or other
  modified_base (311)..(311): a, c, t, g, unknown or other
  modified_base (339)..(339): a, c, t, g, unknown or other
  modified_base (538)..(538): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggattcaccttcgagtggctagtggcatgcnctggctcccgcaggctcccgggnaggggctgggagtgggtgacctaagttntagtggtatgagtgggtaaagtaaataaacggacttagtggtcggaactccgggtaggaaacgggccgtattccgaacctactactaccgaagaacgaaccaacctaccaaagaacctacttcttagtttaccaccaaaatgaaacacgcctggaacgacggacggaacggaaccgacggacagttacgtattaaccgnggttacgcgaagtaggactacgacagtacggaaacgg

SEQ ID NO: 387368 - DNA, 570 bp, Homo sapiens
  misc_feature: GZ8MTXP02J05AS.22.86.H09.1.454.CMB.2.raw
  modified_base (254)..(254): a, c, t, g, unknown or other
  modified_base (342)..(342): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctagtggcatgcactggctccggccagggcctccgggcaaggggctggagtgggtgcaattnatggtatggatggaaataataaagctatagtggactccgtagaaggccgaattcaccagtctccgagacgaacaactccaaagaaccncgtacttcgtttaccaccaaaattcgaaaccaggcctggacgaggccgaggactacggcagtgtatactgtgcgagagatcgactatgaacgtacggaaatcgtttagatcgtcgtagggccaaagggacacgtgtccaaccgtctcttccacgccctaccgaccgaacgggcccaacgtcccggttccttcccccgtcggcccgcccgtcgccctaacgacggcccg

SEQ ID NO: 387369 - DNA, 690 bp, Homo sapiens
  misc_feature: GZ8MTXP02ISKHP.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgacgactctcctgtgcagcgtctggattcaccttcagtggctagtggcatgcacgtcggcctccgcgaggccgtccggggcgaaggggctgggaggtggggtgacctaagttatagtggtatgaatggggtaaataaacgtaaaagacttagtgggtacgggtaccttaccggtaggaaacggggtcccgtaattacccaacccgtaattccctaccgaaagaacgaaacctaaaccgtaacccgaaaacggtaaacctacctttaccgtttacgttttaccctaaacccgtaaaaattcggaaaacctacgacccgttaagggaaacgggacggggaccggaaacggggaacccgaacgggggtactaaacggttagttaacgtttaaccggtggttacggaaccgaaggaacgtacgtaaccggaactaggtaaccggtaaaaccggg

SEQ ID NO: 387370 - DNA, 660 bp, Homo sapiens
  misc_feature: GZ8MTXP02GO8U8.22.86.H09.1.454.CMB.2.raw
  modified_base (227)..(227): a, c, t, g, unknown or other
  modified_base (383)..(383): a, c, t, g, unknown or other
  modified_base (396)..(396): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtggcaattatatggtatgatggaaataataaagactatgtgactccgtgaacggccgattcaccatcctaccagagacaactcaaagaccacttctcgttcacctaaatgaacacgctggaagacggcgagacacggtnagtagtattacgngtgagagagactacggacagtacgaacgtaaaggggtaaacttcgttttagagttccgtacggttacgggggacccgtaaaagggggtacgtacgttacgggttccctaaccggtttccttaaccctttccgaaccggttccctaaccccgtaaacccgggaaacccggggttcccctaaccgtttccccggggtttacccctttaaccccccggtggaccccgttacccccgttgaacccccgttcggaaaacggtaccccgg

SEQ ID NO: 387371 - DNA, 786 bp, Homo sapiens
  misc_feature: GZ8MTXP02F2AVE.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcgagcgtggtggagtcgtgggggagcgtggtccagccgtgggacgtccctgacgactctccgtgtgcaggtcgtctggtacttccaccttcgaggtggactagtggcagtgacctacgtggccctcccggccgacggtcccggtaccggggacgaacgggggtctaggggacggttggggtacggtaaccttaaagtttacgtaaggtttggggttaagttaggtaaaggttaaggggtaaaagttaaaaagttaaaacggtaaccgttaagttacggggtttacgggtaaacccggttacccggggttaagggaaacccgggggtacccgtaacgtttacccaaacccgttacgtacccgttaaccccggaaaggtaacccgaaaacccttaaacccgttaaacccaaaacggtaaacccttaccgtttactttaaccggttttacccctaaactaaaacgtaacgaaacgtacgtaccgtaggaaagggacgggaacgaacggaccggacggacgttaaacggttgttaacgttacggtgtaccggaaggtaagaacgtacgtaccgaaacgtaacggtaacggtaaaccgg

SEQ ID NO: 387372 - DNA, 585 bp, Homo sapiens
  misc_feature: GZ8MTXP02GU9Y4.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgagactctcctgtgcagcgtctggattccaccttcagtggctatggcatcgcacgtcggcctcccgccgaggccgtcccggggcgaacggggctggggaggtggggtagaccgtaattatagtggtataggagtagggtaaacgtaaagtaaagacttagtggtacggtacgtccgtaggaacggcgtacttccgacctactctaccgaagacacaactaccaaagtacacttctacgtttacaaccaaatcgaaactgaccgtgaaggacggacgacggaccgaggctagtacgttacgttacgtggtacgcgaagtagacgtacgactagtacggtaaaccggg

SEQ ID NO: 387373 - DNA, 509 bp, Homo sapiens
  misc_feature: GZ8MTXP02IAUOA.22.86.H09.1.454.CMB.2.raw
  modified_base (242)..(242): a, c, t, g, unknown or other
  modified_base (353)..(353): a, c, t, g, unknown or other
  modified_base (412)..(412): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctctggtaccaacngcacccaggcaaagcccccagactcatcatttatgctgtcaataagcggccctcgacggggtccctgatcgcttctctggctccaagtctcggcacacgcctccctgaccntctctgggcctccgaggctgaagatgagctgattatactgctgctctatttgcaggccncctacgacgttgggtgttcgggcggaggaccagctgaccgtcgtaggcacgccagcctcgcccctcggtccacgtctcgtccccgtccctccgtccg

SEQ ID NO: 387374 - DNA, 731 bp, Homo sapiens
  misc_feature: GZ8MTXP02H83ZE.22.86.H09.1.454.CMB.2.raw
  modified_base (261)..(261): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcggtggtccagccgtgggagtccctgagctctcctgtgcagcgtcnggacttcaccttcagtgctagtggcatcgccacgtcggccctaccggccgaggcccgtcccggggacgaagggggcctggggacggtggggtaggaccctaaagttagtagtaggttataggaagtagggtaaaagttaaaataaacgtacttaagtaggtacggtacccgtccggttagggaaacggggtcccgtaatttaccaacccgtaagttcccgtacccgaaaggaaccgtaacccgaaaaccttaccccgaaaagtaaaccctaactttaccgttacgtttaccctaaaccctaaaagttaccgaaacgtaccggtacccgtaaggaacgggaacggggaaccgaaacgggggttaaccaccgggggtactaaacggggtttacgttaacgtttaccggttggacgggtaacggaaggaacgtacggttaacggaaccgtaacgtttaacggaaaacccgggg

SEQ ID NO: 387375 - DNA, 619 bp, Homo sapiens
  misc_feature: GZ8MTXP02G23PO.22.86.H09.1.454.CMB.2.raw
tcagacatacgcgtcacgaccggtgctcgatttagtgctatagacttgagctctgggagaggagcccagcactagaagtcggcggtgtttccattctgtgatcagcactgaacacagaggactcaccatggagtttgggctgagcttgggttttcctcgttgctcttttaagaggtgtccagtgtcaggtgcagctggtggagtcgtgggggagcgtggtccagcctgggacgtcctgagctctctgtgcagcgtctggattcaccttcagtggctagtggcatcgcacgtggcctccgccgaggcccgtccggggacgaaggggctggggaggtggggtcggactaagtttagtagtggtatgagtagggtaaagttaaagtaaagacgttagtggtacggacgttccggtaggaacgggccgtattaccgacctacgtacctacgaagacgaaccaaactaccgaaacgaacctacttacgttacgtttacctaccctaaaatcgaaacacgccgtaaggacggacgggacggaacggacgacgggtactaacggttacgttaacttacgtggtaacggacgaacggtacgtacgtaccggtaacgagttaaaccgg

SEQ ID NO: 387376 - DNA, 666 bp, Homo sapiens
  misc_feature: GZ8MTXP02HS3KE.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcggtggtccagccgtggggaggtccctgagactctcctgtgcagcgtctggattcaccttcagtggctatggcatgcctacgtcggcctcccgccgacgggccgtcccggggacggaaggggcgtgggagggtggggtaggcccgtaaagtttagtagtagggttagtaggtagtagggtaaaagttaaaagtaaagtacgttaagtggtacggaacctccgggtagggaaacggggtcccgtaaacgttccaaccctagtacctacccgaagtaacgaccctaaaacctaccgaaaacgtaacctacctttacgtttacgtttacctaaacccaaagttaccgaaacgacgtccgagggacggaacgggacggaacggaccgacggggtcagggtttacgtaagtttcgtggcggaacggagagtacgtacgacaggttacgtaaaccggg

SEQ ID NO: 387377 - DNA, 657 bp, Homo sapiens
  misc_feature: GZ8MTXP02F991D.22.86.H09.1.454.CMB.2.raw
  modified_base (383)..(383): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtgactccgtgaaggcgatcacatctcagagacaactaccaaagacactctcgttctaccaaatgaacacgctgagaggcgagacacggcagtgtattacgngtgcgagagatacgacatacgaacgtaaacggggaaacttcgttttagaacttccgttacgggtacgggggaacccgaaagggggtaacctacggttacgggtaccctacccgtttccgttccgtttaccgaccggtcccccttaccccgaaaccccggtaaaccggggtccccctaaaccggtttccccgggttacccccgtttcccccccggtcgggtacccccggtccccccgttacggtcccccgttacccggaacggggtaacccccgg

SEQ ID NO: 387378 - DNA, 544 bp, Homo sapiens
  misc_feature: GZ8MTXP02FJX9F.22.86.H09.1.454.CMB.2.raw
  modified_base (309)..(309): a, c, t, g, unknown or other
  modified_base (333)..(333): a, c, t, g, unknown or other
  modified_base (340)..(340): a, c, t, g, unknown or other
  modified_base (364)..(364): a, c, t, g, unknown or other
  modified_base (391)..(391): a, c, t, g, unknown or other
  modified_base (507)..(507): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgcaggctccgggnaggggctggagtgggtgcaattanatggtangatgggaaataataaagactatgnggactcgtgaaagggccagttcactanctccagagacaactaccaaagaacactctacgtttacctacctaaaactagaaacctacgaccctagaaggacggacggaagggaccacgggacctaggtacggttaattaaccgnggttagaacggagagactacggaactacgtacgaacg

SEQ ID NO: 387379 - DNA, 590 bp, Homo sapiens
  misc_feature: GZ8MTXP02HTAT7.22.86.H09.1.454.CMB.2.raw
  modified_base (273)..(273): a, c, t, g, unknown or other
  modified_base (277)..(277): a, c, t, g, unknown or other
  modified_base (282)..(282): a, c, t, g, unknown or other
  modified_base (284)..(284): a, c, t, g, unknown or other
  modified_base (287)..(287): a, c, t, g, unknown or other
  modified_base (290)..(290): a, c, t, g, unknown or other
  modified_base (293)..(293): a, c, t, g, unknown or other
  modified_base (311)..(311): a, c, t, g, unknown or other
  modified_base (313)..(313): a, c, t, g, unknown or other
  modified_base (316)..(316): a, c, t, g, unknown or other
  modified_base (322)..(322): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggttttcgcgttaggctcttttaagaggtgtccagtgtcaggtgcagctggtggagtcgtgggggagcgtggccagcctgggaggtccctgagactctcctgtgcagcgtctggattcaccttccngtgntgtgnangcncgngcnccgcgcgcgcggcgaggngnggnggtggngacgtatagtagtagtagtgagtaggtaaagtaaagtaaagtaagtaagtagtacggtacgtaccgtacggaacggaccgtacgtaccacctactacctacgaacgaacgacaacctaaccgaaacgtaaactaacttacgttacgttactaacctaaacgtaacgaacgaacgacgtacgaacggacggacggacggacgacggacgtacgtacgtacgttacgtagtacgaacgacgacgtacgtacgaacgtacgtaacgtaacg

SEQ ID NO: 387380 - DNA, 633 bp, Homo sapiens
  misc_feature: GZ8MTXP02IPRHZ.22.86.H09.1.454.CMB.2.raw
  modified_base (330)..(330): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctggagtgggtggcaattatatggtatgatggaaagtaataaagatatgtggactccgtgaaggccgattcacatctacagagacaactaccaaanaacgactctcgtttacctaccaaaatcgaaacacgccctggacgacgggacgaggaccgacgggctaagtgtaattcgtgtgacgagagagtacgtaacgagtacgacgtaaaccggggaaattaccgttttagtacttcgttacgggtacgggggacccaaaggggcctaaccgtacggtctaaccccggttcttccgtttacgaccgtccccttaccgaaacccgaaccggggcccctaacggttccccgtacccgttcccccgtcggtcccggtccctcggaccgttcccgaaggacccg

SEQ ID NO: 387381 - DNA, 571 bp, Homo sapiens
  misc_feature: GZ8MTXP02FLGJR.22.86.H09.1.454.CMB.2.raw
  modified_base (383)..(383): a, c, t, g, unknown or other
  modified_base (389)..(389): a, c, t, g, unknown or other
  modified_base (420)..(420): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctcctacactggaaccagcagtgatggttggtgttatactatgtctctgtaccaacagcaccaggcaaacgcccccagactcatcatttatgctgtacaagtaacgccggcctcgacggggtccccctgactcgcttctctggcctcaagtctgacaacgccggccctcccngacccntcctcgtcgggcctcccgaggctagaacgtntggacggtctagtaatttacttacgtgccttgccttctagttgccgtaggccgtacctacgtacggtttcggggttcgttacggggcgggtaacggacccgtaaaggccgttacggtacccgtcgtacggtccgaacggtcccgtaacggg

SEQ ID NO: 387382 - DNA, 560 bp, Homo sapiens
  misc_feature: GZ8MTXP02GL4UU.22.86.H09.1.454.CMB.2.raw
  modified_base (379)..(379): a, c, t, g, unknown or other
  modified_base (387)..(387): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactatgtggactccgtgaaggccgattcacatctcagagacaactccaaagacactctcgttcaccaaatgaacagcctgagaggcgagacacggcagtntattacgngtgcgaagagatcgaacagtagaacgtaaacggggaaatcttttaggatcgtagtggggaccaagggacacgtcggtccaccgtctcttacgacgtcccctaccgaaccgaacggcccctacgttcccggttcccccttcccgcggcccgtccctcggccctccgacgacccg

SEQ ID NO: 387383 - DNA, 589 bp, Homo sapiens
  misc_feature: GZ8MTXP02IJBP3.22.86.H09.1.454.CMB.2.raw
  modified_base (497)..(497): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggattcaccttcagtggctatggcatgcacgtggcctccggcgaggcctccgggagaaggggctgggaggtggggtgactaaagtttatagttggtatgaagtagggaaaagttaaagtaagtacttaagtggtacgtaaccgtcggtaggaacgggtcctataccgaccatcctaccgagaacaacaactaccaaagaactaccgttacttagtttacccacctaaatacgaaacncgacctaggacggacggacgaaggacgacggactagttagtacttagtgtgtagagagtaagtacgactacgtagacgtaacggaagtttcg

SEQ ID NO: 387384 - DNA, 562 bp, Homo sapiens
  misc_feature: GZ8MTXP02GK0S4.22.86.H09.1.454.CMB.2.raw
  modified_base (349)..(349): a, c, t, g, unknown or other
  modified_base (372)..(372): a, c, t, g, unknown or other
  modified_base (471)..(471): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggcaaggggctgggagtgggtgcaattatatggtatgatggaaagtaataaagactatgtgactccgtagaaggccgattcacatctccagagacaactccaagaacactctcgtttcacaaatnacacgctgagagcgagacacggnagtgtattactgtgcgagagatcgacatcgaacgtaacggggtaatcgttttagaactcgtacgtcggggacctaagggacacgttggaccgtaccgtntccttcaccgtccgacccacggaccgggcccctacgtcccggttcccttaacccccgtcggtcccgtacccctcgtcctaccggacgaccg

SEQ ID NO: 387385 - DNA, 703 bp, Homo sapiens
  misc_feature: GZ8MTXP02IKNEG.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagcgtggtggagtcggtgggggaggcgtggtccgaggccgtgggacggtccctgacgtacctctcctgtgcagtcgtctggtacttctaccttgagtggactagtggacagtcgccgtacgtcggcctcccggccgacggccggtcccgggacgaaggggtctagggaggtgggtagactaagtttagtagttgggtataggtaaagtaaggtaaagttaaagtaaaagtacgtagtggtacggtacgtcggtaggaacggtacgtacttacgacctactaccgtacgaaagaacgaaaccaaaccgttaaccaaaacgtaacctaccttaccgttacgttttaccctaaaccgtaaaagttacgaaaaccgtacgtacccgttaagggaacgggtaaacgggcggtaaaacggaacccggtacgggtaaccgttaggttacgttaaacgtttcgtaggttacggaacggtagtaacggtactaaaccgg

SEQ ID NO: 387386 - DNA, 574 bp, Homo sapiens
  misc_feature: GZ8MTXP02FN9S5.22.86.H09.1.454.CMB.2.raw
  modified_base (569)..(569): a, c, t, g, unknown or other
tcagacatacgcgtcacgaccggtgctcgatttagtgctatagacttggggtttgggggggaagaggaagactgacggtcctgccacaggtggtgctgggcacgggtgggcactcgacacaacatttgcgctcaactgtcttgtctcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctcccgccagggcctccggggcaaagggggctggggaggtggggtggctaaatttagtaagtgggtaatggaagtagggaaagttaaaataaaagactaagtgtaggtactacggtaggaaggggccgatttacagttctaccaagagaaaccaaactacccaaagaaccacttactcgtttacctaccaaaatacgaacagactagacggaggcgaaggacacggcagtgtataacgtgtgacgagagacncgaac

SEQ ID NO: 387387 - DNA, 559 bp, Homo sapiens
  misc_feature: GZ8MTXP02FV30D.22.86.H09.1.454.CMB.2.raw
  modified_base (253)..(253): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattanatggtatgatggaagtaataaagactatgtggactcgtgaaggccgattcacatctccagagacaactccaaagacactctgtttcaccaaatgaacagcctgagagcgagacacggtcagtgtattactgtgcgagagatcgaacagtagacgtaacgggaaagtcttttgactcgtacgtcggggaccaaaggggacacgtcggtcaaccggtctccttcaacgccctaccgaaccgaaacggggccccaagtcccgggttcccttcccccgtcggcccgccccttggaccccgccgacggacg

SEQ ID NO: 387388 - DNA, 693 bp, Homo sapiens
  misc_feature: GZ8MTXP02G1GK2.22.86.H09.1.454.CMB.2.raw
  modified_base (307)..(307): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcggtggtccagccgtggggacggtccctgacgacctctccgtgtcgctagcgttctggtacttccaccttcaggtggcctagtggcatcgcncgtggcctccgcgacggcctcccggggagaagggggcctaggggacggtggggtacgaccttaaagttagttagtggggttaattggaacgttaggggaaaacttaaaagtaaaacggtacttaaggttagggtacggtacccgtaccggttaagggaaacggggtcctaacgtttaccaaccgtacttaccgacccgaagaactaacccaaacgtacccgaaataacctacttcgttacgtttaaccaacccaaatacggtaacacggtaccgtagaaacggcggaacggaacgacgaccggtcgtaggtagttaaacgttaccggttggaggaacccggaaagtacgtacggtaccggaacttaaacggacgttaaaaccgggg

SEQ ID NO: 387389 - DNA, 562 bp, Homo sapiens
  misc_feature: GZ8MTXP02IYAIR.22.86.H09.1.454.CMB.2.raw
  modified_base (364)..(364): a, c, t, g, unknown or other
  modified_base (400)..(400): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagacactctcgttcaccaaatcgaacagcctggacgnggacgagacacggcagtgtattacgtgtgcgagagntacgacatcgaactacgggaaatcgtttgactcgtacgtaggggcccaaaggggtcaacgtggtccaacccggttctacgtttacacgtcccctaccgaccgaaacgggtcccaacgttccggtccgtcccccgtcgggccacccgtgccctcgaacggccg

SEQ ID NO: 387390 - DNA, 643 bp, Homo sapiens
  misc_feature: GZ8MTXP02IGN2R.22.86.H09.1.454.CMB.2.raw
  modified_base (408)..(408): a, c, t, g, unknown or other
  modified_base (432)..(432): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactcctcctgtgcagcgtctggattccaccttcagtggctagtggcatgcacgtggcctccgccgaggccgtccgggacgaagggggctgggaggtgggtggactaaattatagtggtatgagtaggaaagtaaataaagactatggtacggactccggtaggaacgggccgtacttacaccatcctacagacgacaactacaaagacactcttcgttaccaccaaatgaacagcctggagaggcgagacncggctaggtattagtacgtgtcgnggaagagagtacgaacagtacgaacgtaaacgggtaattccgtttttagaacgttccgtacgggttaccggggaaccgaaacgggggtacctacggtcgggtaccctaccggttactaccgttccgacgtcccctacccgaaacccgtaacgggcccctacgtccggttcccctccccgtcggcccgtccctcggtcctaccgcggacccg

SEQ ID NO: 387391 - DNA, 638 bp, Homo sapiens
  misc_feature: GZ8MTXP02IH6WH.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggaggtgggtggcaattatatggtatgatggaaagtaataaagactatgtggactccgtgaaggccgattcaccatctccagacgacaactcaaagacactctcgtttacaccaaatgaacagcctggacgaggcgaaggacacgggcagtagtatactgtgcgagtagatcgacagtgacgtaaacggggaaatcgttttagagttcgtcgtacgggggacccaaagggaccgtacgttacggggtacaacccgggttccttcgtttacccgacggtcccccttaccgtaaaccccggaaacgggggtcccccaaacggtttcccggttaccccgtttaacccccccggttcggggcccctccccccgtttaggaccccctttccggaaaacggggtacccg

SEQ ID NO: 387392 - DNA, 610 bp, Homo sapiens
  misc_feature: GZ8MTXP02JB9XX.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagattgggttttcctcgttgcttcttttaagaggtgtccagtgtcaggtgcagcgtggtggagtcgtgggggaggcgtggtccagccgtgggacgtccctgacgactctcctgtgcagcgtctggattcaccttcagtggctatggcatgcacgtggcctccgccgaggccgtcccgggacgaaggggcgtggggtagggtggggtacgtaacttaagttagtaggtaggtagtagtaagtaaggggtaaataaaacgtaagtacgtagtacgggtacgtaccgttacggaaggaccggtacgtactaccactactccgagaagaacgaaccaactaaccgaaactactacttcgttactacctaaactaacgtacaacgcgtacgaggaacggacggacgacgacggcgtacgtagttactacgtacgtggagaacgagtacgacgtacagtacgtaacgtaaacgg

SEQ ID NO: 387393 - DNA, 613 bp, Homo sapiens
  misc_feature: GZ8MTXP02G1NX0.22.86.H09.1.454.CMB.2.raw
  modified_base (225)..(225): a, c, t, g, unknown or other
  modified_base (440)..(440): a, c, t, g, unknown or other
  modified_base (455)..(455): a, c, t, g, unknown or other
  modified_base (548)..(548): a, c, t, g, unknown or other
  modified_base (591)..(591): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtgctatggcatgcactggctccgcaggcctcgggnaaggggctggagtgggtgactaattatagtggtatgaagtaggaaagtaaataaagactagtggtaggactccggtaggaaacgggccgtaacttcaccatctaccgagacgaacaactccaaagacacgttctacgtttaccaaccaaaatacgaaactacgaccgtaggacgacgggacgaacggaccgacggacgtagttacgtattaacgngtaggacaagagtanacgaatagtacgaacgtaaagggaacttgttagacgtcgtagggtacggaccgaaaggtccgtacgtcggtacctaccgtcttcgtaccgacnccctacccgaaacggacggtccctacgttcccgtccctcccgnggccctcctgcctacgagaccc

SEQ ID NO: 387394 - DNA, 615 bp, Homo sapiens
  misc_feature: GZ8MTXP02JP8SK.22.86.H09.1.454.CMB.2.raw
  modified_base (295)..(295): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggagcgtggtccaggccgtgggaggtccctggagactctcctgtgcagcgtctggattcaccttnagtggctagtggcatcgcacgtcgggcctcccggcccgagggcccgtccgggggacgaaacgggggctacggggagggtcggggtaggactaaagtttataagtgggtaatggaagtaggggaaattaaacgtaaagtactaagtgtaggtacgtccggtaggaaacggggtctagtcctaaccatacctaccaaggacaaacgaacctaccaaagaacctaacttcttacgttacctacaaacgtacgaacacgtccgtagacggagggaccggagacgacggactaggtataagtacgtgtacgagtagacggatacg

SEQ ID NO: 387395 - DNA, 591 bp, Homo sapiens
  misc_feature: GZ8MTXP02G2R13.22.86.H09.1.454.CMB.2.raw
  modified_base (352)..(352): a, c, t, g, unknown or other
  modified_base (423)..(423): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcttgggttttcctcgttgctctttttaagaggtgtccagtgtcaggtgcagctggtggagtcgtgggggagcgtggtccagccgtgggagtccctgagctctcctgtgcagcgtctggattcaccttcagtggctatggcatgcacgtggcctcccgccaggccgtccggggcgaaggggctgggacggtggggtgactaagttanagtggtatgataggaaataataagactaagtggtaggactcgggtagaacgggaccgattaccactatccncagacgaacaaacgtaccaaacgaaccacttacttacgtttcctaacctaaatacgaaacacgtaccgtaggacggacgggacggaacgggaacgaccggacgtaggttagtaattacggagtcgacgagagaagtacgaacacgtacgaacggtaacggtacgttcg

SEQ ID NO: 387396 - DNA, 630 bp, Homo sapiens
  misc_feature: GZ8MTXP02GU5H1.22.86.H09.1.454.CMB.2.raw
  modified_base (254)..(254): a, c, t, g, unknown or other
  modified_base (260)..(260): a, c, t, g, unknown or other
  modified_base (369)..(369): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcngcgtcnggattcacttcagtggctagtggcatgctacgtcggcctcccggccacgggtccgtcccggggacggaacgggggtccttaggggacggtggggtaggcctaaagttanagtgggttatggaagtaggggaaaattaaagtaaacgacttagtacggtgtaccgttccgtaggaaacggtacccgaatttaccaaccctactccgtaccaagacgaaccaaacctaccgaaaagaacctacttcttactttacctaaccaaaactggaaaccagacccgtaggaacgaggacggaacggaccgacggactagtagttaacgttactggtacgaacgaggagtaacaccggaatacgttacggaaaaccgg

SEQ ID NO: 387397 - DNA, 670 bp, Homo sapiens
  misc_feature: GZ8MTXP02H8TBA.22.86.H09.1.454.CMB.2.raw
  modified_base (636)..(636): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctgggtggagtctgggggaggcgtggtccagcctgggaggtccctgagactctcctgtgcagcgtctggattccacctttcagtggctatggcatgcacgtggcctccgccgaggcgtccgggcgaaggggctgggaggtgggtggcaattatatggtatgataggaaagtaataaaagatataggtaggacctccggtaggaacgggccgtattccaacctatcctaccaagaacaaccaacctaccaaacgaaacctactcttccgtttacaacctaaatacgaacacgacctgaagacgggaccgaagaccgacggactagttagttactaacgtgtacggacggaaggtaagtacgtacggaactaaggtacgaaacgttaaacggggtaaagtttcgtttttagactttccggtacggtaccggggaccgaaaggacctacgtacgggtacctacgttcgtaccttcacgtccctacccgaaaccgtaccggtcccacgttccccggtacccttcccccgngggtccctcccgtacgtcccaccggacggacccg

SEQ ID NO: 387398 - DNA, 614 bp, Homo sapiens
  misc_feature: GZ8MTXP02J093K.22.86.H09.1.454.CMB.2.raw
  modified_base (227)..(227): a, c, t, g, unknown or other
  modified_base (254)..(254): a, c, t, g, unknown or other
  modified_base (354)..(354): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtgactaattanagtggtatgataggaataaataaagactatgtaggtactccggtaggaacgggccgtattaccgaacatccctacgagagaaccaactaccaaagaaccnctcttcgttacctacaaatgaacagcctgagaggcgaaggcacggactaggtacgtaacttctggtacgacgagagatacggaatacgtgaaacgtacggggtaaatcttttaggactcgtacggtggggaccaaaggggtactaacgtggtacctacgtactcttacgaccgccctacccgaaccgtaaccgggccctacgttcccggtaccctcccccggtacggcccgtccccgtacgcccgtaccgacgtaccccg

SEQ ID NO: 387399 - DNA, 718 bp, Homo sapiens
  misc_feature: GZ8MTXP02IJX9P.22.86.H09.1.454.CMB.2.raw
  modified_base (228)..(228): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggnaaggggctgggagtgggtgctaattatagtggtatgagtaggaaagtaaataaagactagtggtaggacctccggtaggaacgggccgtatttccgaaccctatcctaccgagaacgaaccaacctaccgaaaagaacctaacgttccttacgtttaccacctaaaatacgaaaccagcccgtaggacggagggaccggaacgggaccgaacgggtcgtaaggttagttaacttacgtggtaggacgaaaggagtacttacggaactaagtacgaaccggttaaacgggggtaaagtttcctttaaggacgttaccgttcgggtacgggggacccgaaagggtaccgtacgtcgggttacctacccggttcttaccgttaccgacggtaccccctacccgaaacccggaacggggtaccccctacggttcccgttaccccgtttcccccgcggccccgttcccgtcggcccgtaccggaacggaccccgg

SEQ ID NO: 387400 - DNA, 612 bp, Homo sapiens
  misc_feature: GZ8MTXP02HK3EB.22.86.H09.1.454.CMB.2.raw
  modified_base (364)..(364): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggacttcaccttcgagtggctagtggcagtcgcacgtggccctccgaccgagggccgtcccggggacgaacgggggctaggggaggtggggtgacctaaagttntagtggtataggacgtgggaaattaaataaagtacttagtggtacgtacgtccgtaggacggccgagttacacatcctcaagacgacaactaccaaacgaactacttcgttacgttactaacccgaaattacgaacacgtaccgtagaacggacgcggaacggaacgtacggacgtacggttagttaacgttacgtaggtcggaacgaaggacgtacgtaccgacgtaacgttacggtaaaaccgggg

SEQ ID NO: 387401 - DNA, 552 bp, Homo sapiens
  misc_feature: GZ8MTXP02GVRKS.22.86.H09.1.454.CMB.2.raw
  modified_base (350)..(350): a, c, t, g, unknown or other
  modified_base (357)..(357): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcactggctcccggccaggcctccggggacgaaggggctggggagtggggtgacctaattanatggtangatgggaaataaataaacgactatgtagactccgtagaaggccgattcacctatcctaccaagacaacaactacaaagaaacacttctacgtttacaaccaaaatcgaaacagccaggaacggagacggaacggacaccgggctaaggtcgtatacgtgagaacgaagagacgtacgaacgagttacgaaaacgg

SEQ ID NO: 387402 - DNA, 533 bp, Homo sapiens
  misc_feature: GZ8MTXP02G7XVO.22.86.H09.1.454.CMB.2.raw
  modified_base (293)..(293): a, c, t, g, unknown or other
  modified_base (387)..(387): a, c, t, g, unknown or other
  modified_base (517)..(517): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttnagtggctatggcatgcactggctcccgcaggctccgggcaaggggctggggagtgggtgctaattatagtgggtatggaagtagggaaataaanaaagactatgtggactcggagagggcgatcacatctacagacgacaactaccaaagaactactcttgtttacctacaaatacgaacacgccgtagagacggacgaaggacacggacagtagtaacgtagngtgacgagtagatacg

SEQ ID NO: 387403 - DNA, 706 bp, Homo sapiens
  misc_feature: GZ8MTXP02I754J.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagcgtgggtggagtcggtgggggaggcggtggtccaggccgtggggacggtccctgacgtcctctccgtgtgcagcgtcgtggtacttccaccttcgagtcggtctagtggacagtcgcctacgttcgggcccttccccggaccgacgggtccccgtccggggacggtaaacgggggtcgtaggggacgggtggggtacgtactaaagtttagtagtggggttaatggtaagttaacggggtaaattaaaagtaaaagtacttaagtcggtaggtaccgttacgggtagggaacgggtaccgtacttaccgaacctgtacctaccgaaagaccgaactaaccgtaccaaaggtaacctactactttacgttaccaaacgtaaactacgaaaccgacgtaccgtacggaagggaccgggaccgaaaggaccgtaccggaagttacggtacggttaacttaccggtaggacggaaggagtacggtaactaccgg

SEQ ID NO: 387404 - DNA, 727 bp, Homo sapiens
  misc_feature: GZ8MTXP02JPSQT.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagactctcctgtgcagcgtctggattccaccttcgagtggctagtggacatgcctacgtggcctcccgccgaggccgtccggggacgaaggggctggggaggtggggtgacctaagttatagtggtataggagtaggggaaaattaaagtaaaacggtacttaagttagggtacgggtaaacccgttacccgggtagggaaacggggtacccgtaacgtttacccaaacccgtattacccgtaccgaacgaaccgaaaccctaaacccgttaacccgaaaacgtaaaccgtaaccctttaccgtttacggttttaacccctaaaccctaaaagttaccggaaaacctaccggtaccgttaaggaaacgggacgggaacggaaacgggaaccggacggtaccgtaaggttacggttaacgtttaccggttagacgggtaaccgaaggtaacgtacgtacgaaacctaaggtaacgttaaaaccgggg

SEQ ID NO: 387405 - DNA, 629 bp, Homo sapiens
  misc_feature: GZ8MTXP02IXM9J.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgacgactctcctgtgcagcgtctggacttcaccttcagtggctagtcggcatgcacgtcggcctcccgcgaggcccgtccggggcgaaggggctgggaggtggggtgacgtaattgtagtggttatggataggggaaattaaataaaggtactagtggtaggtactcggtagaacgggtccgattccgacctatcctacgagtaacgaacaacctaaccgaaacgtaacctaacctttcgttaccgtttactaacctaaaagtacgaaactacgaccgtagaacggagggacgaacgggacgaccggtacgtaaaggttagttaacgttacgtagttagggaaccgtaaggacgtaacgtcggaaaccgtagttaacggtaaaacccggg

SEQ ID NO: 387406 - DNA, 627 bp, Homo sapiens
  misc_feature: GZ8MTXP02GQ120.22.86.H09.1.454.CMB.2.raw
  modified_base (227)..(227): a, c, t, g, unknown or other
  modified_base (271)..(271): a, c, t, g, unknown or other
  modified_base (400)..(400): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtgcaattatatggtatgataggaataanaaagactatgtgactcgtaggaacggccgtatcaccatctaccagacgacaactaccaaagacacttctcgttacaccaaatcgaacagcctgagacggacgaggacgacggacagttagtacttacgnggtacgacgaagagtatacgatagacgtaaacgtaacggggtaaattcgttttagacgttcgtacgggtacgggggacccaaaggggtaccacgttcgggtacctacccggttctccgttacgacccgtaccctacccgaaaccggacgggtaccccctacgttccccggttcccttcccccggtacggccccgtccccgtcggtacccctaccgggacggtacccg

SEQ ID NO: 387407 - DNA, 703 bp, Homo sapiens
  misc_feature: GZ8MTXP02IOUZM.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctggagtacctctccgtgtgcgaggcgttctggacttcctaccttcgaggttggctagtggctagtcgctacgtggcctaccccggccgagggccggtcccggggacggaacggggcgtggggagggtggggtacggacctaagttagtagttggtaagtggtaagtaggggtaaaattaaataaaacggtacttaaggttcggtacgggtaccgttacgggtaaggaacggggtctaacgttccaaccgtatccctacgaagtaacgacctaaacgtaccaaagtaacctacctttcttaccgtttactaacccgaaatacggaaactacgtaccgtaggaacggacgggaccggaaacgggaccgtacgggaaccttaaggttacgttaacgttacgtaggggtgtaaccggaacggtaagtaccgttaacggactaacgggttaacggttaaaacccggggg

SEQ ID NO: 387408 - DNA, 617 bp, Homo sapiens
  misc_feature: GZ8MTXP02HXHXH.22.86.H09.1.454.CMB.2.raw
  modified_base (401)..(401): a, c, t, g, unknown or other
  modified_base (413)..(413): a, c, t, g, unknown or other
  modified_base (578)..(578): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtgctaattatagtggtatgatagggaaataaactaaagactaatggtaggactccggtgaacgggccgattcaccatctccagacgacaactcaaagaacactctacgttcaccaatgaacagctgagaggcgaggacacggctagtgtattacgngtgacgagaagngtacgaacagtcgaaacgtaacgggtaaattcgtttagaacgttcgttacgggacgggggaccgaaaggggactacggttcggtaccctaccggttcttaccgttcgacgtcccctaccgaaacccggacgggtcccctaggttccccgtcccgtttccccccgngggccccttaccccggtcgtacccgtccgacgggacccg

SEQ ID NO: 387409 - DNA, 679 bp, Homo sapiens
  misc_feature: GZ8MTXP02H5C99.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgccaggcgtccgggcgaaggggctgggaggtggggtggctaaattatagtggtatgaagtaggaaagtaaataaagactatgtaggactccggtaggaacggcctatccacctatcctacaagaacgaaccaactacaaaacgtaacctacttcttactttacctaacctaaaatacgaaacacgacctgggaacggagggaccggaacggaaccacgggactaaggttagtaacgttacgtgtacgacggagtaagacgtacgaacgagtacgtaaacggtaacgggttaaaagtttcgtttaaggtacgttaccgtcgggtacggggaaccgtaaaggggacctacggtcggtacctaccgttcttaccttcgaccgtaccctaccgaaacccggaacgggtccctacgttcccggtccccttccccgacggtcccgcccgttacgccctccggaacgccg

SEQ ID NO: 387410 - DNA, 542 bp, Homo sapiens
  misc_feature: GZ8MTXP02F8WWN.22.86.H09.1.454.CMB.2.raw
  modified_base (271)..(271): a, c, t, g, unknown or other
  modified_base (292)..(292): a, c, t, g, unknown or other
  modified_base (335)..(335): a, c, t, g, unknown or other
  modified_base (532)..(532): a, c, t, g, unknown or other
  modified_base (539)..(539): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggagcgtggtccagcctgggaggtccctgagactctcctgngcagcgtctggattcaccttnagtggctatggcatgcacgtggcctcccgccaggcctccgggnaaggggctgggagtgggtgactaaattatagtggtatggaattaggaaagtaaataaaagctaatgtaggactcggtagaaaggggccattcaacctatactacaagacgaacaactaccaaagaacctactctatttacacaaaatgaacagacgacgagaggacgagacgacgacgagtagtaattacgtagtgngagaganacg

SEQ ID NO: 387411 - DNA, 693 bp, Homo sapiens
  misc_feature: GZ8MTXP02JYR38.22.86.H09.1.454.CMB.2.raw
  modified_base (230)..(230): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggccgtccgggngaaggggctgggaggtgggtggctaattatagtggtatgagtaggaaagtaaataaagactagtggtgacgtccggtaggaacgggccgtattccaacctatcctaccgaagacgaaccaaactaccgaaaagaaacctacttacttccgtttacctaccgtaaatacgaaccgacgtaccgtggaacggacgggacgaacggaccgaacgggtctaaggttcgtaagttacgtggtagcggaagacgtactacggaactagtacgaacggttaaacggggtaaacttcgttttagacttcgtaccggggtacggggaacccgtaaacggggtaccgtacgttcgggtacccctaaccggttccgttaaccttccgaacgtccccctaacgaaacccggtaccggacccctagtccccgttaccccgtccccgtgccccgtccctcgccctaccgacggaccc

SEQ ID NO: 387412 - DNA, 737 bp, Homo sapiens
  misc_feature: GZ8MTXP02JGEAV.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagctctcctgtgcagcgtctggattcaccttgagtggctagtggcatcgctacgtcggcctccccggccgacgggtcccgtcccgggggacgaaggggggtccgtaggggacgggttcgggggtggaccctaaagtttagtagttcgggtaataggaacgttagggggaaaattaaaacgtaaaaggtacttagttcgggtacggtaaccgtacccgggtaggaaacgggggtccctaagtttcccaaccgtatcccgtaaccgaagacgaacctaaacctaaccgaaacgtaaactaccgttacttaccgtttacaaaccctaaaagttacgaaactacggtacctagggaaacgggacgggaaccggaaacggggtacccgaacggggtaccgttaagggtttacgtttaacgttaaccggttcgggtacggaacggggaaacggtaacggtaacggttaaccggaaccttaacggtaaacggttaaaaccggggg

SEQ ID NO: 387413 - DNA, 820 bp, Homo sapiens
  misc_feature: GZ8MTXP02F8L5J.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccagccgtgggagtccctgagactctcctgtgcagcgtctggattcaccttcgagtggctagtggcagtgccacgtcggcctcccgccgaggtccgtcccggggacgaagggggtctggggacggttgggggtacggaccctaaagtttagtaaggttagggttaagtaggtaaagttagggggtaaaaaccgttaaaagttaaaaaggggtacctttaaggttacggggttaccggggtaaacccgtttaccccggggtaaggggtaaaccggggtacccggtaacgtttacccgaaacccgtacttacccgttaaccccgaaaggtaaaccggaaaaccccgtaaaaccgttaaccccaaaaacggtaaaccccttaacccgtttacctttaaccgggttttaaccccttaaacccaaaaacgttacccggaaaaccgtaccggtaaccccgttaggaaacgggacggggtacccggaaaggggaacccggaacgggtaccgtaacgggttaagtttacgtttaaccggtggttaacggaacggaacggaaacgtacgttaccgggaaactttacggaacggtttaaaacccgggg

SEQ ID NO: 387414 - DNA, 670 bp, Homo sapiens
  misc_feature: GZ8MTXP02GBIOS.22.86.H09.1.454.CMB.2.raw
  modified_base (358)..(358): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccgaggcctccgggcaaggggctgggagtgggtgactaattatagtggtatgagtaggaaagtaaataaagactagtgtggactccggtaggaacggccgattccacctatctaccagaacgaccaactaccaaagaaaccnctcttcgtttaccaccaaatcgaacagcctggaggaggacggaaggaccacgggactaaggttctaattacgtggtacgagaagagatcgaactagtacgaacgtaaacggggtaattaccgttttagaacttccggtacgggtacggggaacccgtaaagggtaccctaacggttacgggtaccctaacccgggttcttaccgttacaccggtacccctacccgaaacccggtaacgggccccctaaggttcccccggttccccttcccccggtcgggcccctcccgtcgtcccgtaccggaacggtcccg

SEQ ID NO: 387415 - DNA, 570 bp, Homo sapiens
  misc_feature: GZ8MTXP02HJWLP.22.86.H09.1.454.CMB.2.raw
  modified_base (189)..(189): a, c, t, g, unknown or other
  modified_base (412)..(412): a, c, t, g, unknown or other
  modified_base (436)..(436): a, c, t, g, unknown or other
  modified_base (441)..(441): a, c, t, g, unknown or other
  modified_base (458)..(458): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggcctccgccgaggcctccgggcaaggggctgggaggtgggtgactaattatatggtatgaatagggaaataaataaacgataagtggtaggactccggtaggaaacgggccgtattcaaccatctaccaagagaacaactccaaaagaactactcttaccgtttacaaccgaaaatcgaacagcctgagagcgagactacggnagtatatacgtgagacgagagtanacganagagaacgtaagtattnttagactcgtacggacgggacgaaggactacgtcgtacctacgtctctacaccgtccaccgaacgaccgtcctacgtcccgtaccctcccgcgcctcctcgcctacgacgcc

SEQ ID NO: 387416 - DNA, 780 bp, Homo sapiens
  misc_feature: GZ8MTXP02GTZKN.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtccagccgtgggacggtcctgagactctcctgtgcagcgtctggacttcaccttcagtggctagtggcagtgcctacgtcggccctcccggaccgacggtcccggtcccggggacggaaacggggtcgtaggggagggttgggggtacggacccgttaaatttaagttaagttagggtttagaggtaaagttaggggtaaaagttaaaaggtaaaaggtaaccttagttacggtacgggtaaacccgttaccgggttacgggaaacgggggtacccgtacgtttaccctaacccgtacttacccgtaccgaaacgggaaaccgtaaacccgaaacccttaaacccgaaaacggtaaaacccttaccctttaccgtttacggttttaccctaacccgtaaaacgttacgaaaaccgtaacggtaaacctagggaaccggaacgggaaccggaacgggaaccggtaccgggtacgttaacgggttaagtttaacgttaaccgttggtaccggaacgtaacggaagtacgttacgaaaccgtagtacgggttaaaaccggg

SEQ ID NO: 387417 - DNA, 680 bp, Homo sapiens
  misc_feature: GZ8MTXP02I0TK0.22.86.H09.1.454.CMB.2.raw
  modified_base (253)..(253): a, c, t, g, unknown or other
  modified_base (259)..(259): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggaggcgtggtccagccgtgggnggtccngagctctcctgtgcagcgtctggattcaccttgagtggctagtggcagtgccagtggcctcccgccgaggcccgtccggggacgaaagggggtctggggacgggtggggtggactaaatttaggggtaattgggggtaatggtaaagtagggtaaaagttaaaacgtaaagtacgttaaagtggttacggaacgttacgggtagaaacgggggtcccgtaagtttccaaccttactaccgtacccaaaggaaacgaaaccctaaaccgtaccgaaaacgaacctacgttaccttagtttaccctaaaccgtaaaattacggaaaacctaacgcccgtaaggaggaacggacggaaacggaccgacggtaaccgtaagttaacgttaagttaacgtggtaggaccgagtaagtaccgtaacg

SEQ ID NO: 387418 - DNA, 634 bp, Homo sapiens
  misc_feature: GZ8MTXP02H8ZYU.22.86.H09.1.454.CMB.2.raw
  modified_base (253)..(253): a, c, t, g, unknown or other
  modified_base (284)..(284): a, c, t, g, unknown or other
  modified_base (382)..(382): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggaggtgggtggcaattntatggtatgatggaagtaataaagactatgnggactccgtgaaggccattcaccatctaccagacgacaactccaaagaccactctcgtttccaccaaatgaacagcctgagaggcgagtaccgacggnaacgtgtatactgtgacgagagatcgaacagtcgaacgtaaacgggaaagttccgttttagaacgttccgttacgggtaccgggggaacccgtaaaggggacctacgtacgggttccaacccgttctccctttacgacgtaccccttacccgaaacccggaaacgggtccccctaacgtttcccccggtaccctttaacccccccggtacggtccccgtacccccttcggcccttacccgaacggggacccc

SEQ ID NO: 387419 - DNA, 569 bp, Homo sapiens
  misc_feature: GZ8MTXP02H5EWH.22.86.H09.1.454.CMB.2.raw
  modified_base (189)..(189): a, c, t, g, unknown or other
  modified_base (423)..(423): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggctccgccaggctccgggcaaggggctgggagtgggtagcaattatagtggtatgataggaaataataaagactatggtgaactccgtaggaaggggccgtattaccaccatcctaccagacgaacaactacaaaagaacactcttcgttacaccaaatgaacagcctgagaggcgagacacggcagtgtatacgtagtgacgagagatcgaanatacgaacgtaacggaaattctttgatcgtcggagggaccgaaggacacgtcggcctaccgtcgtcttacgcgccctaccaaccggaacgccctacgtcccgtcccgttccccgtcggcccgtccctcgccctaccgacggacccg

SEQ ID NO: 387420 - DNA, 685 bp, Homo sapiens
  misc_feature: GZ8MTXP02HWDYD.22.86.H09.1.454.CMB.2.raw
  modified_base (241)..(241): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtgggacggtccngacgctctcctgtgcagcgtctggacttccaccttcagtcggcttagtggacagtgcctacgtcggccctccggccgacgggcccgtcccggggacgaacgggggtcgtaggggtaggtcggggtagacctaaagtttagtagtaggtatagaacgtagggaaattaaaactaaagtcgttaagttcggtacggaccgttaccggtagggaaacggtacccgtacttcccaacccgtaactccgtaacccgaaggtaaccaccaaaaccgtacccaaaagtaaccttacgtttacttacgtttaacccaactaaaagtccgaaactacggccgtaaggacgggaacgggaaccgggacggaaaccctacggggacctaggttacgttaaacgttcgtggtacggaacgtaaggatacgtacgaacgtagttaacggaaaccggg

SEQ ID NO: 387421 - DNA, 729 bp, Homo sapiens
  misc_feature: GZ8MTXP02JJM11.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcagcgtggtggagtcgtgggggagcgtggtccagccgtgggacggtccctgacgtactctccgtgtgcagcgtctggattcaccttcagtggctagtggcatgccacgtcggccctcccgcgagggcccgtcccggggacgaagggggtcctaggggtacgggtgggggtcgtaaccgtaaagtttagtaggtagggttatagggtaaagttaggggtaaaagtttaaaacgtaaaaggtacttaggttacggggtacggtaacccggtaccgggttagggaaaccggggtacccgtaacgttaccaacccgtacgttccctaaccgaacgaacgtaaacccgtaaaacctaccgaaaacgaaccttaccttacgttacttttacccaaacctaaagttacgaaacgtacgaccgtaggaacgggacggacgggaacggacggtaaccggacggtacgttagttaacgttaccggttaggacggaacgaacggtaaaggtactacggtaaacgtacggtacggttaaaacccgggg

SEQ ID NO: 387422 - DNA, 702 bp, Homo sapiens
  misc_feature: GZ8MTXP02HTBJ0.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgttgggttttcctcgttgcttcttttaaggaggtgtccagtgtcaggtgcagctggtggagtcgtgggggagcggtggtccagccgtgggacggtccctgacgactctccgtgtgcagcgtctggacttccaccttcagtggctagtggcatgccacgtcggccctccgccgaggtcccgtccggggacgaacggggtctggggaggttggggtaggacctaaagtttagagttgggttaatggaagtaggggtaaaagttaaaataaaacggtacttaaagtgggtagggtaaacccgtccgggttaaggaaacggggtccctaacgtttcccaaacccgttacttaccccgtacaaagggaaccgaaaccctaaaccgttaaccccaaaacgaaacctaaccgtttactttacgtttttaccaaaccctaaaaagtaccgtaaaacgaccgtaccgtaggaaccgggaagggacggtaaacggacccgaggacgtaggttacgtagttaccgtgttaggaacgaggacgtacacgtaacgtaacgtacgtaacgg

SEQ ID NO: 387423 - DNA, 641 bp, Homo sapiens
  misc_feature: GZ8MTXP02I3DCL.22.86.H09.1.454.CMB.2.raw
  modified_base (226)..(226): a, c, t, g, unknown or other
  modified_base (249)..(249): a, c, t, g, unknown or other
  modified_base (290)..(290): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggnaggggctggagtgggtgcaattntatggtatgatggaaagtaataaagactagtgtgactccgngaaggccgattcacatctcagagacaactccaaagaaccactctacgtttccaccaaatcgaaacacgcctggagaggcgagacaacggcagtgtattactgtgacgagagactacgactagtacgacgttaaacggggaaagttccgtttttagaactttccgttacggttacgggggaccctaaaggggacctacgttacgggtacctaacccggttcttccgttaccgaccggtaccccttacccgaaacccgaaaccgggggtccccctaacggttccccggtttacccgttccccccgtcgggccccgtaccccgtaccggtcccgttacccgaacggggtacccg

SEQ ID NO: 387424 - DNA, 622 bp, Homo sapiens
  misc_feature: GZ8MTXP02IYZE4.22.86.H09.1.454.CMB.2.raw
  modified_base (225)..(225): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctcgggnaggggctggagtgggtgcaattatatggtatgatggaaagtaataagactatgtgactccgtgaggcgatcaccatctccagacgacaactccaaagaacactctcgtttcaccaaatacgaacacgcctggagaggacgaaggaccacgggcagtagtattacgtgtacggacgtagagactacggacaagtagaacgtaacggggaaattcgttttagattccgtaggtacggggaccgtaagggactacgttcggtcctaccggtcttccgttcgaccgtaccccgttacccgaaacccggtaaaccggggtcccctaaaccgttcccgggttaccccctttcccccggtcggtccccgtaccccgttcggcccctaccggtaacggaacccgg

SEQ ID NO: 387425 - DNA, 718 bp, Homo sapiens
  misc_feature: GZ8MTXP02FHK8S.22.86.H09.1.454.CMB.2.raw
  modified_base (253)..(253): a, c, t, g, unknown or other
  modified_base (261)..(261): a, c, t, g, unknown or other
  modified_base (274)..(274): a, c, t, g, unknown or other
  modified_base (284)..(284): a, c, t, g, unknown or other
  modified_base (302)..(302): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcgtgggtttcctcgttgctcttttaagaggtgtccagtgtcaggtgcagctggtggagtcgtgggggaggcgtggtccagccgtgggacgtcctgagactctcctgngcagcgtntggattcaccttnagtggctagnggcatgctacgcggtccncccgacgacggtccggtccggggacgaagggggctggggagggtgggtacggactaaatttagtagttgggtataggaagtaggaaaagttaaaacgtaagcgtaaagttcggtacgggtaaccgttcggtaagggaaacgggtcccgttaattaccccgacaacttccgtaacccgaaacgaacgaaaccctaaacccgtaccaaaacgtaacctaccttcgttaacgtttccccaaacaaaattacgggaaaccacggttcctaaggggagaacggggccggaaacgaccggaaaaccgggacgttaggttacggtttaacttaccggtagggtacgggtaacggaaggtaacgtaagtacggaaaactacggttaaacgggtaaaccggtaaaacgggggttacgtttttacg

SEQ ID NO: 387426 - DNA, 522 bp, Homo sapiens
  misc_feature: GZ8MTXP02FD7OL.22.86.H09.1.454.CMB.2.raw
  modified_base (251)..(251): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattnatggtatgatggaaagtaataaagactatgtggactccgtgaaggccattcaccatctccagagacaactccaaagaacactctcgtttctccaaatgaacagcctgagaggcgaggacacgggcagtgtattactgtgcgagagatcgacatagactaacgggaaagcttttgatctcgtggggcccaaagggacactggtcaccgtctctcagcctaccaccaacgggcccactccggtcctcccccgtgccgccctcgctccaggacg

SEQ ID NO: 387427 - DNA, 628 bp, Homo sapiens
  misc_feature: GZ8MTXP02IE402.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctagtggcatgcacgtggcctccgccgagggccgtccggggcgaaggggctgggaggtggggtgcctaattatagtggtatgattggggaaattaaataaagtactagtggtggaccgtccgtaggaacggggccgtactttcgaacctacttcctacccaagacgaaccaacctaccgaaacgaaacctacttccgttacgttttaccctaacctaaaattcggaaaactacggtaccccgttaggaaggaacggggaccggaaacgggaccgaaccggggtctaaagggttacgttaagtttacgttggtcggaacggagacgtagtacgactagtacggtaaaccgg

SEQ ID NO: 387428 - DNA, 587 bp, Homo sapiens
  misc_feature: GZ8MTXP02FX0RQ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggccgtccgggcaaggggctgggagtgggtggcaattatatggtatgataggaaagtaataaagatatgaggactcggtgaaggccgattcacatctaccagaagacaactaccaaagaacacttctcgtttactaccaaatacgaacaggcctggaagagggacgaacggacacggacagtagttattacgtgtgagagagatacgacagtacgagtaaacgggaagttctttgatctacggtgggacccgaaggggaccacgtcgtacgtaccgtctccttacgacgtccctaccgaccgaaccggccctacgtcccgtcccttaacccccgtcggccctcccgtaccgtcccgtaccgacggacccg

SEQ ID NO: 387429 - DNA, 578 bp, Homo sapiens
  misc_feature: GZ8MTXP02IN0E4.22.86.H09.1.454.CMB.2.raw
  modified_base (229)..(229): a, c, t, g, unknown or other
  modified_base (416)..(416): a, c, t, g, unknown or other
  modified_base (445)..(445): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcctccgggnaaggggctgggagtgggtgcaattatatggtatgatggaagtaaataaagactatgtggactccgtgaaggccgattcaccatctcagagacaactccaaagacactctcgtttccaccaaatgaacagcctggacgaggacggagaccacgggctagtgtattacgtgtcgacgagagatcgacangaacgtagggaaatctttgatcgtacggngggaccgagggactcgtcggtactaccgtctcttaccgacgtccctaccgaacccgtaacgggtccccaacgttcccggttacccttcccccgtcgggtccccgcccgttcgcccgttaccgacggggacccg

SEQ ID NO: 387430 - DNA, 646 bp, Homo sapiens
  misc_feature: GZ8MTXP02HQJPY.22.86.H09.1.454.CMB.2.raw
  modified_base (410)..(410): a, c, t, g, unknown or other
  modified_base (438)..(438): a, c, t, g, unknown or other
  modified_base (468)..(468): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggctccgccaggctccgggagaaggggctgggagtgggtgcaatttatagtggtaatgagtaggaaataaataaacgattaagtggtacggacttccggtaggaacgggccgtatttccacctaattccaccgaagacgtaaccaacttaccgaaaagtaaccaccttcttacgtttacccaacaaatcgaaacacggtcnggaggacggacgaacggacgtaacgggntagtagttattacgtgacgagaagacgtanacgatagtacgtaaacggtaaacggttaaacgtttgtttagtacgtacggtacgggtacgggaccgaaggactacgttcgacctaccgtctcctcgacgtaccaccgaccggaccgtaccgtaccgttcccgtcccgtcccggtcgtacccgtcccgtaccgtcccgtacggacgccg

SEQ ID NO: 387431 - DNA, 596 bp, Homo sapiens
  misc_feature: GZ8MTXP02F33MX.22.86.H09.1.454.CMB.2.raw
  modified_base (227)..(227): a, c, t, g, unknown or other
  modified_base (521)..(521): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggctccgggnaagggggctgggagtgggtggactaagttatagtggtatggataggaaataataaagctaatggtcggactccggtaggaaacggcgattcgaccatcctacagacgacaacctcaaagaacactctcgtttaccacaaatgaacagcctgagaggcgtaggacacggacgtagttagtaacttacgtgtacggcgagagatacgacagtacgacgtaaaggggtaaacttcgtttagaacttcgtacgggtggacccgaagggtacactcgggtaccaccgtcttactcgacncccgtaccaaccgacggtccctacgtcccggttaccctcccccggtgccccgtccttacgcctcccgaggtaccc

SEQ ID NO: 387432 - DNA, 641 bp, Homo sapiens
  misc_feature: GZ8MTXP02FWR5D.22.86.H09.1.454.CMB.2.raw
  modified_base (260)..(260): a, c, t, g, unknown or other
  modified_base (429)..(429): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctagtggcatgcacgtggcctccgccaggcctccgggcaaggggctagggacgtgggtgactaattanagtggtatgagtaggaaagtaaataaagactatggtggacctccggtaggaacgggccgtaattccaacctatctaccagaacgacaaacctacaaacgaacactctaccgttttacaccaaaatcgaactagcctagagacggcgagacgtaggcagtagtattacgngagagagagatacgaacagtacgtaacgtaaacgggtaaattcgtttagacgttccgtacgggtacgggaaccgaaaggtacgtacgtcggtaccgtaccgtcttaccgtacgaccgtaccctaacccgaacccggaaccggaccccttaccggttcccggttaccccgtcccccggtacggccccgtcccgtccgacctaccgacggaccg

SEQ ID NO: 387433 - DNA, 562 bp, Homo sapiens
  misc_feature: GZ8MTXP02ICEI8.22.86.H09.1.454.CMB.2.raw
  modified_base (227)..(227): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctggagtgggtggcaattatatggtatgatggaaagtaataaagactatgtggactccgtgaacggccgattcaccatctccagagacaactccaaagaacactctgtttcctaccaaatgaacagcctgagaggcgaggacacggcagtgtatactgtgacgagagatacgacagtagaacgtaacgggaaattctttagattctcggtacggggaccaagggacacgtcggtcaccgtctccttacacgccctaccgacccaaacggggccccaacgttcccggtcccttcccccgtcggcccgtccctcggccctccgacggaccg

SEQ ID NO: 387434 - DNA, 718 bp, Homo sapiens
  misc_feature: GZ8MTXP02FH62X.22.86.H09.1.454.CMB.2.raw
  modified_base (319)..(319): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtggggagtccctgagactctcctgtgcagcgtctggattcaccttcagtggctatggcatgcactcggctcccaccgaggccgtccgggnaagggggctggggaggtggggtggacctaaagtttatagtgggtaatggaagttaggggaaaacgttaaaagtaaaaggaccttaaagttgggtagggaacccgttaccggtagggaaacggggcccgtaattaccgaaccctactcctacccgaagaacgtaaacctaacctaaacccgaaaacgaaaaccctaccgttaccgtttacgttttaccctaaaccctaaaaagttacgaaaacccgtacgcccgttaaggaaacgggaacggggacccgggaaaacggggaacccgaaacggggtacccgaaagggtttacggttaactttaaaccggtgggttacggaaccggaacggtaaggtaaccgttacgaacgtaacgtaggtaaaaacccggg

SEQ ID NO: 387435 - DNA, 517 bp, Homo sapiens
  misc_feature: GZ8MTXP02FUKB7.22.86.H09.1.454.CMB.2.raw
  modified_base (487)..(487): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcgtctggattcaccttcagtggctatggcatgcactggctccgccaggcctccggggcaaggggctgggagtggggtggcaattatatggtatgatgggaaataaataaagactagtgtgactcgtgaaggcgatcacatctacagagacaactaccaaagaacactctagtttacctaccaaatcgaacacgaccgtagagacggcgaaggacacggacagtcgtattacgngtcgcgagagtactacgacagtagtaacgg

SEQ ID NO: 387436 - DNA, 701 bp, Homo sapiens
  misc_feature: GZ8MTXP02FG2QG.22.86.H09.1.454.CMB.2.raw
  modified_base (254)..(254): a, c, t, g, unknown or other
  modified_base (666)..(666): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggctccgggcaaggggctgggagtgggtgcaattanatggtatgataggaaagtaataaagactatggtcggactccggtaggaaacgggccgattccgacctatcctaccaagacgaaccaacctaccaaacgaactaccttcttaccgtttacctaacccaaaattacgaaaccacgacccgtgaacgggacgggacggaacgggaccgacgggacctaggttagttaacgttaacgtggtacggacggaagaacgagttaccgaaacgtagtacgaaccggtaaacggggtaaacgttcgttttagaacttccgtacgggtcgggggaacccgaaaggggtacctaacggtcggtaacccgtacccgttacgttccgttacgaccgtcccaaccccgtaacccggaaaccgggtcccctacggtcccggttcccgttcccccggnggtcccccgcccgtcgtcccgaccgacggaccccg

SEQ ID NO: 387437 - DNA, 616 bp, Homo sapiens
  misc_feature: GZ8MTXP02IXH4B.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggaggtcgtgggggaggcgtggtccagccgtgggaggtccctgagactctcctgtgcagcgtctggattcaccttcagtggctatggcatgcacgtcggcctccggccgacggcctcgggggccaaggggggccttggggagtgggtaggcaattagtaatgggtaatggaatggaaagtaataaaagactagtgtggactaccggtgaaagggtccgagttcaccatactaccgacgacaacaccaccaacgaactacaccctacttactacaactacacacgcgagagacggacgagacgacgacgtagtagtagttagtagtagagagacgagacgacgacgtacgtaacgtaacggttaagtacgttacgacgtacgtacggtacggacgaacggacgacgtcgtcgtaccgtacgtcctacctaccgacccgacccgaccgaccgacccgtcccgtcccgtcccgtcccgtccgcccgtccgccgtaccgacgacg

SEQ ID NO: 387438 - DNA, 675 bp, Homo sapiens
  misc_feature: GZ8MTXP02FVTBS.22.86.H09.1.454.CMB.2.raw
  modified_base (567)..(567): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttggctgagcttgggttttcctcgttgcttcttttaagaggtgtccagtgtcaggtgcagcgtggtggagtcgtgggggagcgtggtccagccgtgggacgtccctgacgctctcctgtgcagcgtctggtattccaccttcaggtggctagtggcagtgcctacgtggcctccccggccgacgggtcccgtacccggggacgaaggggggtcctaggggacggtggggtacggaccctaaagtttagtaggttggttaataggaagttaggggaaaattaaaagtaaaaggacttagtcggtagggtacccgttacgggtaggaacgggccgtaattacccaaccgtactccctaccgaagaacgaaaccaaccttaaccgaaacgaaaccttaccttctttacgtttacctaacctaaacgtacgtaaacncgtaccgaggaacggacgggacgaacggaccgacggacgtaaggttacgttacgttaacgtggtagaacggtaagacgtacgtaccgaatacgtacggtaaaaccggg

SEQ ID NO: 387439 - DNA, 512 bp, Homo sapiens
  misc_feature: GZ8MTXP02FGZMG.22.86.H09.1.454.CMB.2.raw
  modified_base (344)..(344): a, c, t, g, unknown or other
  modified_base (406)..(406): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggggaggtccctgagactctcctgtgcagcgtctggattcaccttcagtggctatggcatgcactggctccgccaggctccgggcaagggggctggggagtggggtggccaatttanatggtatgatggaaagtaaataaagactatagtggactccgtagaagggccgattcgaccanctcagagacaactccaaagaacactctgtttacctacccaaatgaaacacgcctagagaggcgaggacacggcagtgtattactgtgcgagagatcgacatgaacg

SEQ ID NO: 387440 - DNA, 702 bp, Homo sapiens
  misc_feature: GZ8MTXP02FZ6M7.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggaggtgggtgctaagttatagtggtatgaatggaaagtaaataaagactatggtggactcggtagaaggccgattccacatctccagagacaactaccaaagaacactctgtttacaccaaatcgaacagcctggagacggacgagacacggcagtgtattactggtagacgagagcgtacgaactagtagaacgttaaacggggaaattcgttttagaagttccgtacgggtacgggggtaacccgaaaacgggggactaaccgggttacgggttaccccgtaaaccccggtttcctttccgtttacccgtaaccggttacccccgttaccccgaaaacccggtacccgggggtacccccttaaacccggttccccgggtttacccccgttccccccgggttaccggggcccccgttaccccccggtttcggaccccggttaccccggaacgggtaacccccgg

SEQ ID NO: 387441 - DNA, 590 bp, Homo sapiens
  misc_feature: GZ8MTXP02JB1EY.22.86.H09.1.454.CMB.2.raw
  modified_base (176)..(176): a, c, t, g, unknown or other
  modified_base (390)..(390): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttccncgttgctcttttaagaggttgtccagtgtcaggtgcagctgggtggagtcgtgggggagcgtggtccagccgtgggagtccctgagctctcctgtgcagcgtctggattcaccttcagtggctagtggctatgaccacgtcggcctcccgccgaggtcccgtccggggacgaaacggggtctaggggacggtggggacgtacgtaagtttaagngttggggtatagggtaataggggaaagttaaagtaaagagttaagtggtacggtacgtccggtaggaacggccgtagttacacctagtcaccgagacgaacaacctacaacgaacactcttacgtactacaatacgacagactcgagacggacgaggacgacgacgagtagtaacgtacgagtacgacgagacgactacg

SEQ ID NO: 387442 - DNA, 571 bp, Homo sapiens
  misc_feature: GZ8MTXP02GNMLK.22.86.H09.1.454.CMB.2.raw
  modified_base (310)..(310): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagcctgggagtccctgagactctcctgtgcagcgtctggattcacttcagtggctagtgcatgcactggctccgcaggcgtccggganaggggctgggagtggggtagacctaaagttatagtggtaatgaagttaggggaaataaacgtaaaagactagtgtagacctacggtagaaacgggcctattacaacctatcctacaagaacaaacaaacctaacaaagaaacctacttacttacgtttacaacctaaaagtacgaaacctagacctaggagaggaccgaaggacgacggtacgaggtacgttactacgtgagaacgagacgatcgaactacgtagtaacgg

SEQ ID NO: 387443 - DNA, 634 bp, Homo sapiens
  misc_feature: GZ8MTXP02G3Z8N.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattccgaccttcgagtggctatggcagtgcacgtggcctcccgcaggcctccggggagaaggggtctggggaggtggggtaggactaaagtttatagtggggtataggagttagggaaattaaacgtaaagtactaagtggtacggtacgtccggtaggaacgggtaccgtattaccaaccgtattcctaccgaaggtaacgaaacctaacgtaccgaaacgtaaacctaccttaccgttacgtttaccaacccgtaaaattacgaaaccacggtacctaggacggagggaccggaacggaccgacggactaagttgtaaacgttcgtaggtcgacgaaggagtacgtaacg

SEQ ID NO: 387444 - DNA, 615 bp, Homo sapiens
  misc_feature: GZ8MTXP02H489I.22.86.H09.1.454.CMB.2.raw
  modified_base (192)..(192): a, c, t, g, unknown or other
  modified_base (549)..(549): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggaggcgtggtccagccgtgggaggtccctgagactctcctgtgcagcgtctgattcaccttcagtggctatggcatcgcacgtggcctccgcccgagggccgtccggggacgaaagggggctaggggaggtgggggtagaccgaaatttaatagtggttaatggaagttaggggaaaggttaaaaataaaacggtacttaagtgggacgtaccgtacccgtaggaaaggggtacccgtattacaaccctagttacaccaagaacaaccaaacacccaaagaaacctacttactctttaccactaaaatacgaaacagccagagaggacgaggaaacncggactaagtgtaaacttcgtgtaggaacgaggaaagtacgtaccggaaactaacgtaacgtaacg

SEQ ID NO: 387445 - DNA, 640 bp, Homo sapiens
  misc_feature: GZ8MTXP02JDN9U.22.86.H09.1.454.CMB.2.raw
  modified_base (190)..(190): a, c, t, g, unknown or other
  modified_base (231)..(231): a, c, t, g, unknown or other
  modified_base (256)..(256): a, c, t, g, unknown or other
  modified_base (361)..(361): a, c, t, g, unknown or other
  modified_base (369)..(369): a, c, t, g, unknown or other
  modified_base (404)..(404): a, c, t, g, unknown or other
  modified_base (489)..(489): a, c, t, g, unknown or other
  modified_base (613)..(613): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttnagtggctatggcatgcactggctccgccaggcgtccggganaggggctgggagtgggtgactattntagtggtatgacgtagggtaaataaactaaagattatgggtacggacctccggtaggaaacgggcctataccaccgtatccgtacagaacgaccaactacgaaanacactttntaccgtttaccaacctaaatcgaaactcggtccgngggaacgtaggggaccggacgggaaccgtacgggactaagttgtaaattaccgtgtaggacgaaggtactacggtacggaactanacggaaacggttaaaccggagtttctttacggattccgtaggggtagaaccgaggacgtacgtcggaacctcgtctacttccagaccctaccgacgaacgggtcctacgtccggtaccctccgngtccctacgtcgccgtaccgaggaccc

SEQ ID NO: 387446 - DNA, 700 bp, Homo sapiens
  misc_feature: GZ8MTXP02HYDSD.22.86.H09.1.454.CMB.2.raw
  modified_base (252)..(252): a, c, t, g, unknown or other
  modified_base (257)..(257): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcngcgtnggattccaccttcagtggctagtggcagtcgctacgtggcctcccgccgacgggtccgtcccggggacgaaggggctggggtacgggtcgggttaggacctaaagtttagtagttgggtataggtaagtaggggtaaaaattaaagtaaaagtacgttaagttcgggtacggtacccgttacccgggttaagggaaacgggtcccgttaagtttcccgaaaccctacgttccctacccgaaagtaaccgaaaccaaaccgtaccgaaacgtaaacctacctttcgtttacgtttaccctaaaccgaaaacgttacgaaaccgtacggtaccgtagggaaggaacggggaccggaagggtaccgaaacggtcgtaaaggttgttaaacgttacgtggtacggaacggaggaagtacgtacgaacgttagtaacgggtaaaccgg

SEQ ID NO: 387447 - DNA, 695 bp, Homo sapiens
  misc_feature: GZ8MTXP02JVYHH.22.86.H09.1.454.CMB.2.raw
  modified_base (335)..(335): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcggtggtccagccgtgggacgtccctgacgactctctgtgcaggcgtctggacttccaccttcgaggtggctaagtggacagtgctacgtcggacctcccgccgaggccgtcccggggngaaggggctaggggaggtgggtacggacctaagttagtagtggtagtagaagtaggggtaaaagtaaactaaagtacgtagtacggtacggaaccgtcgggtaagggaaacgggtcctaacgttacccacctagttcccaacgaacgaaacgaccctaaacgtaacccgaaagtaaaccctctttaccgttacgtttaccccaaacgaaacgttacggaaaacccttccgggaaccgtagggaacgggaaacgggtaccgggaacggaaaccggaccggggacttacggttaagttacccgttacgtaagggtcgaaccggagtagttaacgaccgaactaacggtacggtaaaaccggg

SEQ ID NO: 387448 - DNA, 670 bp, Homo sapiens
  misc_feature: GZ8MTXP02JULWN.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtgggacggtccctgagactctcctgtgcagcgtctggattcaccttcagtggctagtggcatgcacgtggcctcccgccgagggcccgtcccggggacgaaggggctggggaggtggggtcggacctaaatttagtagttggggttatggaagtaggggtaaaattaaagtaaaaggacttagtaggtagggaccgtaccggtaggaacgggtccgtaattaccaccgtactcctacccgaagaacgaaccaacctaccgaaacgtaaacctaccttccgtttacgtttaccctacctaaaagttcgaaacgacgtaccgtaggaacggaacggggacggaacgggaaccgaccggggaccgtaaggttacgttacgtttaccgttaggtacggaacggtaaggaagtacgtaccggaactacggtacggtaaaacccgggg

SEQ ID NO: 387449 - DNA, 654 bp, Homo sapiens
  misc_feature: GZ8MTXP02IP33G.22.86.H09.1.454.CMB.2.raw
  modified_base (363)..(363): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaggctggtgggagtcgtgggggaggcgtggtccaggccgtgggaggtccctgagctctcctgtgcagcgtctggtattcaccttcagtggctagtcggcatcgcacgtcggcctcccgccgaggcccgtccggggacgaaggggtcgtgggaggtggggtggacctaagttntagttggtatggtaacgtaggggtaaagttaaataaagtacgttagtggtaggtacctccgggtagaacggggtaccgattaccgactagtccctacgaagaacgaaccaaccgtacaaacgaacctacttccgtttacgtttacctaaaccgaaaattcgaaacctcggtaccgtaggaaggggaacggacgggaacggaccgaaacgggtcgtaaaggttcgttaagttaaccggtggacgtaacggaaggtacgtacgacggtaactacggttaacggaaacccgggg

SEQ ID NO: 387450 - DNA, 698 bp, Homo sapiens
  misc_feature: GZ8MTXP02G8QA0.22.86.H09.1.454.CMB.2.raw
  modified_base (228)..(228): a, c, t, g, unknown or other
  modified_base (375)..(375): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggngaaggggctgggaggtgggtggcaattatagtggtatgaataggaaataaataaagactataggtacggactaccggtaggaacgggccgtaattccgaccatcctacagacacaactaccaaagaccactctcgttacacctaaangaacagctgagacggcgaagaccgacggcaggttagtattcgtaggtaggacgagtagacgtacgaaacgtagtacggtaaacgtaaacggggtaaagtttaccgtttaggtagttacccggttacgggtaccgggggtaacccgtaaaggggtaaccgtaccggttccggggtaccttacccgggttacccttcctttaacccgaaaccgtccccgttaaaccccgaaacccggaaccgggtacccgttaacgttccccggtttaccccttccccggtaccgtccccggtcccgtccgtcccgtaccggaacggtaccccgg

SEQ ID NO: 387451 - DNA, 685 bp, Homo sapiens
  misc_feature: GZ8MTXP02IWWWX.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtgactccgtgaaggcgatcacatctccagagacaactaccaagaacactctcgtttctaccaatagaacagcctgagaggcgaggacacggcagtgtattactgtgacgagagatacggacagtacgacgtaaaccggggtaaaagtccgttttagaagttcgttcggttagggggacccaaagggggtaccacgttacggggtacctaacccggttccttaccgttttccgaaacggtcccccgtttaccccgaaaacccccgggttaaaacgggggccccccctaaacggtttacccccgggtttcccccgtttcccccccccggtttacgggggaccccccgttccccccccggtttaaaggcccccgtttacccccggaaccggggttaaacccccggg

SEQ ID NO: 387452 - DNA, 689 bp, Homo sapiens
  misc_feature: GZ8MTXP02ISOM7.22.86.H09.1.454.CMB.2.raw
  modified_base (193)..(193): a, c, t, g, unknown or other
  modified_base (217)..(217): a, c, t, g, unknown or other
  modified_base (231)..(231): a, c, t, g, unknown or other
  modified_base (263)..(263): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtcgtccgggtctcctggacagtcagtcaccatctcctacactggaaccngcagtgatgttggtgttataactntgtctctgtaccangcaccagacaaacgccccagactcatcattangctgcaataacgcgcctcgacgggtccctgactcgcttctctggctaccaagtctggaccaacccgccgcctcctggacagttcagtcgcccgtccggtccgaggatacggacggacttagtaaacgttttacgttaaccgtggttcgaccgtagaccgtaaggttacgggaaactttaaccgaaaccgtttggaaccgttaggtaacgtttacccggtttaaaggggtttcgggggttaacggtttccgggggaccggggtaaacggggtaaaccccggtacggggtaccgtaccgggtacccggttaccgtacggtacccgtaaccggtacccggtaacgggtccccgtacccgtcccccgttacggtaaccctacccgttcccgttaccccggtcccccgtccccgttaccgtaccggtaccg

SEQ ID NO: 387453 - DNA, 619 bp, Homo sapiens
  misc_feature: GZ8MTXP02HJ26F.22.86.H09.1.454.CMB.2.raw
  modified_base (355)..(355): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaaggggctgggagtgggtgcaattatatggtatgataggaaataataaagactagtgtggactcggtgaagggccatcacatctcagagacaactccaaagacactctcgtttaccaccaaatcgaaacncgaccgtgaagggacggacgacgggacctacgggataagtagttacttacgtgtgaggagaagtagacgaacagtacgaacgtaaagggaaagttcttttagatcgtacgggtacggggaccgaaaggggacctaacgtcgggtacctaacccggttctccctttacgacgttccctacccgaaaccggaaacgggtccccacgtttcccggtcccctttcccccgcggcccgcccttcggacccttaccggacggtaaacccg

SEQ ID NO: 387454 - DNA, 639 bp, Homo sapiens
  misc_feature: GZ8MTXP02HPP06.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacggtccctgagactctcctgtgcagcgtctggacttcaccttcagtggctagtggcatgctacgtcggcctcccgccgagggccgtcccggggacgaaagggggctggggtaggtcgggggtaggaccctaaagtttagtagttagggttataggaagttaggggaaaagttaaaacgtaaaagtacttaagtcggtagggtacctccggtaggaaacgggcctaattcgaacctatcctaccgagaacgactaactaccaaacgaacctacttcttacgtttacaacctaaagtacgaacacgccgtaggaacggacggacggaacggaccgacggtactaacggttagtaacgttacggtggtaggaacggaagagtactaccggactaaggttacgaaaaccgg

SEQ ID NO: 387455 - DNA, 581 bp, Homo sapiens
  misc_feature: GZ8MTXP02I1QCO.22.86.H09.1.454.CMB.2.raw
  modified_base (441)..(441): a, c, t, g, unknown or other
  modified_base (460)..(460): a, c, t, g, unknown or other
  modified_base (466)..(466): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcctgagactctcctgtgcagtcgtctggacttcaccttcagtcggctatggcagtgctacgtggcctcccgcagggccgtcccggggacgaaggggctggggtacggtggggtggaccctaagtttagtagtgggtaatggaataggggaaagttaaaataaagtactaagtggtggactccggtaggaacggcgtatcacacgtccncaagacgactaacacaaanacactntacttacaccaaatgaacagaccgtagacggaggacggtaacggaccgacggtacgagttacggttacttaacgtggtagaacgaagtacggactacgacgtagtacggaaacgg

SEQ ID NO: 387456 - DNA, 663 bp, Homo sapiens
  misc_feature: GZ8MTXP02JWHLS.22.86.H09.1.454.CMB.2.raw
  modified_base (265)..(265): a, c, t, g, unknown or other
  modified_base (271)..(271): a, c, t, g, unknown or other
  modified_base (468)..(468): a, c, t, g, unknown or other
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagctgggttttcctcgttgctcttttaagaggtgtccaaagtgtcaggtgcagctggtggagtcggtgggggaggcggtggtccaggccgtggggacggtcccgtgacgactctcctgtcgcngcgtcngattcacctcagtgctagtggcatcgacacgtcggcctccggccgacgggccggtcccggggacggaacggggtcgtaggggtacggtggggtcggtaaccgtaagttagtagtaggtagtaggagtaggtaaagtaaataaacggtactagtggtacgtaaccgtcggtaaggaacggcccgtatacccaactacncctacaaggtaccaaaccctaacgtaaccaaacgtacctcttacgttactttaccaaacctaaagtacaaaaccgtgtaccgaggaacggacgggaacgaaccggtacggacggtactaggggttacctaagttccggtaggtcggaaacggagtaaaccgtgaacccgtaactaagggttacggtaaaaccggg

SEQ ID NO: 387457 - DNA, 598 bp, Homo sapiens
  misc_feature: GZ8MTXP02HVW5G.22.86.H09.1.454.CMB.2.raw
  modified_base (373)..(373): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgataggaagtaaataaagactatgtggactccgtgaaggccgattcaccatctccagagacaactcaagaacatctgttcaccaaatcgaacagctgagaggcgagacacggnacgtgtattactgtgcgagagatcgacatgaacgtaaccgggaaagtcgtttttaggacttactacggtggggaccgaaaggggactaacgtcggtaccaacccggtcttacccgttcgacgtacccttacccgaaccgaaaccgggccccgtaacgttccccggtaccctttcccccccgtcgggttccccgccccgttacgcccgttaccggaacggacccgg

SEQ ID NO: 387458 - DNA, 591 bp, Homo sapiens
  misc_feature: GZ8MTXP02IO73C.22.86.H09.1.454.CMB.2.raw
  modified_base (228)..(228): a, c, t, g, unknown or other
  modified_base (251)..(251): a, c, t, g, unknown or other
  modified_base (349)..(349): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggctccgcaggctccgggnaggggctggagtgggtgcaattntagtggtatgataggaaataataagatagtgtgactccgtagaaggcgtatcacatctcagacacaactccaaagaccactcttcgttacaccaaatnaacagcctgagaggcgagacgacggcagtgtatacgtgtgacgagtagacgtacgacgtaagtacgaaccgtaaagggtaaacgtttcgtttagacgttccgttcgggaaccggggacccgaaggggacctacgttacggccgttaaccgtcttcgttacacggttcccacgaaccgtaacggcccttacggtccgttcccgttccccgcgcccgtcccgtacgtccgtaccgacggacccg

SEQ ID NO: 387459 - DNA, 627 bp, Homo sapiens
  misc_feature: GZ8MTXP02JPHQH.22.86.H09.1.454.CMB.2.raw
  modified_base (261)..(261): a, c, t, g, unknown or other
  modified_base (284)..(284): a, c, t, g, unknown or other
  modified_base (595)..(595): a, c, t, g, unknown or other
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagtcttgggttttcctcgttgtcttcttttaagaggtgtccagtgtcaggtgcagctggtggagtcggtgggggaggcggtggtccagccgtgggacgtccctgacgtactctccgtgngcagcgtcgtggacttccacctnagtcggctagtggctagtcgctacgtcggccctcccgcgacggcccgtccggggacgaggggtcgtagggaggtggggtacgacctaagttagtagtgggtatggaagtagggaaattaaagtaaagtacttagtggtacgtaaccgtcgggtaggaaacgggtctacttaccgaccactccaccgaagacgaaccaactaaccaacgtaaactactccgttacgttaccaaccaaatacgaacgacgtaccgaggagacggacgaaacggcgaccggtactaggttacttacgttacgtggtgaacgganaacgtacgacggactagggtactaaacccggg

SEQ ID NO: 387460 - DNA, 717 bp, Homo sapiens
  misc_feature: GZ8MTXP02I0MAP.22.86.H09.1.454.CMB.2.raw
  modified_base (668)..(668): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgagactctcctgtgcaggcgtctggattcaccttcagtggctagtggcatcgcacgtggcctcccgccgagggtcccgtcccggggcgaacgggggtcctaggggaggtggggtaggacctaaagtttagtagtgggttaatggtaagtagggggtaaagttaaaagtaaacgtacttaagttggtacgggtacccgttaccgggtaggaaaccggggtcccgtaagttacccgtaacctacgttccctacccgaaggaacgaccaaaccttaacccgaaacgtaaacctacctttaccgttagttttaccctaaacctaaaacgttacggtaaaaccacggtacccgttagggaaacgggtaaacggggaccggaaaacggggacccgtaacccgggggactaacgggttaggtttaactttaccggnggttacggaacgtaaggaagtacgtacgaactaggttaccggtaaacgg

SEQ ID NO: 387461 - DNA, 639 bp, Homo sapiens
  misc_feature: GZ8MTXP02GL4VZ.22.86.H09.1.454.CMB.2.raw
  modified_base (438)..(438): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcacttcagtgctatggcatgcacgtcggcctcccgcgacggccgtccggggacgaaggggcctggggaggtggggtcgacctaagttagtagtaggtatggaataggggaaattaaaagtaaaaggacttaagtggtagtaccgtccgtagggtaacggccgtaattccaactntcctacaagaacgaccaactaccaaagaaacctacttacgttacgtttacctaaccaaaacgttacgaaaacctacgtacccgtaggaaacgggacgggaaccgggaaacgggaacccgaggtaccgtaaggttagttaacgttacgtagggttacgaacggaaggtaagacgtacggtaactaggtacggtaaaaccggg

SEQ ID NO: 387462 - DNA, 835 bp, Homo sapiens
  misc_feature: GZ8MTXP02G37ZB.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcctccgggcaaggggctgggagtgggtgctaattatagtggtatgaagtaggaaagtaaataaaggactagtggacggaccgtccggtaggaacgggccgtattaccaccaatccgtaccgaagaacgaaaccaaacctaccaaaacgtaaacctaccgtttaccttaccgttttaccctaaccctaaaaagtacggaaaacctaccggaccctaggggaaacgggaaacgggggtaccggaaacgggaacccggtaacccggggtataacgggttttacggttaaatttaaaccggttggggtacggaccggaaaggtaaacgggtacttaacccggggaaactaaaggttacggggaaaaccggtttaaaacccggggggtaaaagttttcctttttaaggtaaccgggtttccctaacgggggttaacggggggaaaaccccgtaaagggggtaaccctaaccggtttacggggttacccctaacccccgggttcttcccgttaacccgaaccgtacccccgtaccggaaaccccggaacgggtccccctaggttccccggttacccctcccccggtggcccccgtcctcggtccctacccgggaacgcccg

SEQ ID NO: 387463 - DNA, 580 bp, Homo sapiens
  misc_feature: GZ8MTXP02FOOMA.22.86.H09.1.454.CMB.2.raw
  modified_base (263)..(263): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctacactggaaccagcagtgatgttgtgtatatatgtctctgtaccaangcaccaggcaaacgcccccagactcatctatttatgctgtacaagtaacgccgcctcgacggggtccccctgactcgctttctctcggctccagtctgcaacgacggccctccctgaccctatccgtcgtcgggtcctccgaggtcgtagaacgtatggaacggctagtaatttagttacctgccttgtccttactagtttcgcgtaacggtcccgtaccgttaacgtacggtttcggggtcggttccggggacgggtacgggacccaaggtccgtacgtaaccggttccgtaggtccgaaccggtcccgtaaacgg

SEQ ID NO: 387464 - DNA, 797 bp, Homo sapiens
  misc_feature: GZ8MTXP02I313I.22.86.H09.1.454.CMB.2.raw
  modified_base (481)..(481): a, c, t, g, unknown or other
tcagacatacgcgtcacgaccggtgctcgatttagtgctatagacttgggtttgggctgagctgggttttcctcgttgcttcttttaagaggtgtccagtgtcaggtgcagctggtggagtcgtgggggaggcgtggtccagcctgggaggtccctgagactctcctgtgcagcgtctggattcaccttcagtgctatggcatgcacgtggcctccgcgaggccgtccggggacgaagggggctgggaggtgggtggactaattatagtggtatgagtaggaaagtaaataaagactagtaggtacggtaccgtccggtaggaaacggggccgttaacttccaacccagtcctacccgaagaacggaaccaaacccttaaccaaaacgaacctactttcgttaccgtttaccaaccgtaaaatacgaacaccgcctggaaggacggtacgacggaccgacggctagttagttacgttacgnggtacgaggaagaacgtacgtacggtaactagtaaccggtaacggttaaaacgggggtaaactttcgttttaaggacgtttacccgggtacggggttaccgggggaaacccgaaacggggtacgtacccggttaacgggttccccctaaacgggtttcccttacccgtttacccggaaccgttaccccccggtaaccgaaaccccggggtaaacccggtcccgttaacccggttcccccggttttacccccttcccccggggtccggtcccccgttaccccgtcggtaccccgtacccggtaacggggtaaccccg

SEQ ID NO: 387465 - DNA, 588 bp, Homo sapiens
  misc_feature: GZ8MTXP02JRCCM.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctgggagtccctgagactctcctgtgcagcgtctggattcaccttcgagtggctatggcagtgcactggcctccgcgaggctccggggcaaggggctgggagtggggtagacctaattagtatgggtataggactagggtaaagtaaagtaaggaccttagtgggtagaccgtccgtaggaacggtacccgtattccgaaccatcctaccgaagacaacaacctaccaaagaacctactacgttcgttacctaccgaaaattcgaaacacgtccgtaaggacggaggaccgaaagggaccacgggactaggtagttaacgttacggagacggaacgagacgtactacgacgtaggtacgaacg

SEQ ID NO: 387466 - DNA, 571 bp, Homo sapiens
  misc_feature: GZ8MTXP02FKAOG.22.86.H09.1.454.CMB.2.raw
  modified_base (311)..(311): a, c, t, g, unknown or other
  modified_base (327)..(327): a, c, t, g, unknown or other
  modified_base (336)..(336): a, c, t, g, unknown or other
  modified_base (343)..(343): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagccgtgggaggtccctgagactctcctgtgcagcgtctggattcacttcagtggctatggcatgcactggctccgcaggctccggnaggggctggagtgggngctaaattnatggtangataggaaattaatagactagtgtaggactcggtagaacgggtcgattccgacatcctaccagactaacaactaccaaagacaactcttagtttacctaaccaaatgaaacacgtacgtaggaaggacggcgaaggaccgaccggtactaggttagttaacttacgtggtcgacggtaagacgtaacgtcgaacgtatacggtaaacccggtaaagggtaacgtttcg

SEQ ID NO: 387467 - DNA, 726 bp, Homo sapiens
  misc_feature: GZ8MTXP02GI13O.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccgaggcgtccgggacgaagggggctgggaggtgggtggactaattatagtggtatgagtaggaaagtaaataaagactagtggtggtacctccggtaggaacggccgtattcaaccgatcctacaagacgaacaactaccaaagaactacttcttacgtttacctaccaaaatacgaaacacgtccgtaggagacgggacggacggaccgacggacgtaagttagtattacgtggtacggacggaagagtacgtacgaacgtacgtacggaaccggttaaacggggtaaacgtttacgttttacggtacgttacccggttacggggtaccgggggaaacccggtaaggggtaacctacggttcggtacccgtacccggttcttaccgttaccgacccgtacccgtacccgtaaacccggtaacccgggtaccctaaccggttccccggttaccccgttcccccggtcgggtaccccgtcccggtcgtacccgaccggacggtaacccgg

SEQ ID NO: 387468 - DNA, 671 bp, Homo sapiens
  misc_feature: GZ8MTXP02GJF4J.22.86.H09.1.454.CMB.2.raw
  modified_base (436)..(436): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcgtccgggcgaaggggctgggaggtggggtggacaaattatagtggtatgataggaaagtaaataaagactatggtggactccgtaggaaggccgtatccacatctacagagaccaactaccaaagaaccactcttacgtttacctactaaatacgaaacacgtccgtggaagacgggacggaacggaccgaacggcgtaagttagtaagtttacgnggtacggacgaagacacgtacgataagacgtaaacggtaaacgggtaaattcgtttagacttcgtacgggtacggggaaccgtaaaggggacctaacggtcggtacctacccgttcgttaccttacgaccgtaccctaccccgaacggaaccggtaccccgtacgttccccgggttccccttcccccgttcggggacccctccccgtacggacccgttcccgaacgggtaccccg

SEQ ID NO: 387469 - DNA, 571 bp, Homo sapiens
  misc_feature: GZ8MTXP02F74ZJ.22.86.H09.1.454.CMB.2.raw
  modified_base (443)..(443): a, c, t, g, unknown or other
  modified_base (447)..(447): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggagcgtggtccagcctgggaggtccctgagactctcctgtgcagcgtctggattcaccttcagtgctagtggcagtgcctactgggcctcccgccagggccctccggggcgaaagggggtcctggggagtggggtgactaaagttatagtgggtatgaagtagggaaagtaaacaaaagctagtgtggactccgtggaaggcacttcaccgntccncagacgaccaactcaaagaccactctgtttaccaactaatagaactgcccgtagaggacgggcgaaacgggccgaacggtcaagtttagaagtttacgtaggtacgacgaaggtagacgtaacg

SEQ ID NO: 387470 - DNA, 585 bp, Homo sapiens
  misc_feature: GZ8MTXP02JZO99.22.86.H09.1.454.CMB.2.raw
  modified_base (289)..(289): a, c, t, g, unknown or other
  modified_base (368)..(368): a, c, t, g, unknown or other
  modified_base (483)..(483): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggattcaccttcagtggctagtggcatgccncgtcggcctcccgccgaggccgtccggggcgaacggggctggggacggtggggtacggacctaagttatagtaggttanggattgggaaagttaaataaagctaagtggtcggactcggtagaacggccgattcaccatcctaccaagacaacactaccaaagactactcttacgttacaaccaaatcgaaacncgtacgtgaaggacggacgtaacgggaccgacggacgtaaggttgttaacgtaccgttggtacgaacggaaggacgtacgtacgacctagtacggtaaacgg

SEQ ID NO: 387471 - DNA, 667 bp, Homo sapiens
  misc_feature: GZ8MTXP02I99N0.22.86.H09.1.454.CMB.2.raw
  modified_base (275)..(275): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacgtccctggagtactctcctgtgcagcgtctggattcaccttnagtgctagtggcatgcacgtggcctccgcgacggccgtaccggggacgaaggggctggggaggtggggtcggacctaagttagtagttgggtataggaagttacgggggtaaattaaaacgtaaagacgttagtgggtacgggaccgttaccgggtaggaaacggggtcctattacccaccgtaattcccgacaacggaacaacctaaacctaaccgaaacgtaacctaccgtttacttacccgtttactaaaccctaaagtaccgaaacgtacgtccgtaagggaacggacggggacggaaacggggacgaccgggtacgtaaaggttcgtaacttacggtggtacggaacgtaggaacgtacgacgaaccgtaggtaacgtaaaaccggg

SEQ ID NO: 387472 - DNA, 676 bp, Homo sapiens
  misc_feature: GZ8MTXP02HSMC0.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggaggtccctgacgactctcctgtcgcagcgtctggacttccaccttcaggtggctagtggctagtcgctacgtcggcctcccggccgacggccgtcccggggacgaacggggctggggaggtcggggtaggacctaaagtttagtagttgggtataggagttaggggtaaaacgttaaaagtaaagtacttaagttgggtacggtaaccctcggtaagggaacggggtcctaactttcccgaacctacttcccgtaccaaggaaccaaccaaaccgtaaccaaacgtaacctaacctttcgtttacttttacccaaaccaaaagttccgaaacaacgccgtaaggaacggacgggaacggaacggaccgacggtacgtaggttagttaaccttacgttagcggaacgaggaacgtacgtacgtaccaggttaaccgtaaacggg

SEQ ID NO: 387473 - DNA, 600 bp, Homo sapiens
  misc_feature: GZ8MTXP02GCN6O.22.86.H09.1.454.CMB.2.raw
  modified_base (251)..(251): a, c, t, g, unknown or other
  modified_base (392)..(392): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaaggggctgggagtgggtgctaattntagtggtatgagtaggaaagtaataaagactagtgtggactccggtagaacgggccgtattcacatcacagacacaactcaaagacactctcgttcaccaatacgacacgctggagacggacggagaccgaggctaggttnttaacttacgtgtacgacggagagtactcgaacagtacggaaacgttacgggggaaatttcgtttaggacttccgtacgggacggggaacaaggggtacctcggttacggtccaacccggttctacttccgaacgtcctacccgaaacgccggtccctacggttcccgttcctccccggtggcccctcgtccgctaccggacgtcccg

SEQ ID NO: 387474 - DNA, 609 bp, Homo sapiens
  misc_feature: GZ8MTXP02JXQVH.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggttgtccagtgtcaggtgcagctggtggagtcgtgggggagcgtggtccagccgtgggacgtccctgagactctcctgtgcagcgtctggtacttcaccttcagtggctatggcagtgcacgtcggcctaccgccgagggccgtccggggacgaacggggtctaggggagtggggtcggactaagtttagagttcggtagtggagtaggaaagttaaacgtaaagattagtggtaggactccggtaggaacggggccgtattccaaccgtatcctaccgaagacgtaacactacaagactatcttagttacaccaaaagtcgaacgtacgaccgtggaacggacgggacgaaagggacgtacggcctaaggttagtaacgttacgttaggacggacgaaacggtagacgtaaccg

SEQ ID NO: 387475 - DNA, 644 bp, Homo sapiens
  misc_feature: GZ8MTXP02HA7II.22.86.H09.1.454.CMB.2.raw
  modified_base (280)..(280): a, c, t, g, unknown or other
  modified_base (298)..(298): a, c, t, g, unknown or other
  modified_base (363)..(363): a, c, t, g, unknown or other
  modified_base (392)..(392): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtgggacggtccctgacgactctcctggtcgcagcgtctggacttccaccttnagtggctagtggcatgcncgtcggcctcccgccgacggccgtcccggggagaggggtctggggaggtggggtgacctaagttntagtcggtatgaagtaggggaaattaaanaaaggtacttagtggtacggtacgtccggtaggaccgggcctattacccaccgtattccgaccgaagtaccgaacctaacctaaaccaaagtaaccttcgttactttaccgtttaccaaccaaagtacgaaacctaggtacccgtaggaacggacgggaccgaaacggggacccaaggggaccttaggttacgttaacgttaccggtgtacgaacggaagacgtacgtacggaactgtaacggtaaaccggg

SEQ ID NO: 387476 - DNA, 568 bp, Homo sapiens
  misc_feature: GZ8MTXP02JWLET.22.86.H09.1.454.CMB.2.raw
  modified_base (188)..(188): a, c, t, g, unknown or other
  modified_base (226)..(226): a, c, t, g, unknown or other
  modified_base (343)..(343): a, c, t, g, unknown or other
  modified_base (373)..(373): a, c, t, g, unknown or other
  modified_base (555)..(555): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcactggctccgcaggctccgggnaaggggctgggagtgggtgctaattatagtggtatgataggaaagtaaataaagactatgtggactccggtagaaggccgattccactatcctacagagaacaactaccaaagaacncttctcgtttaccacaaatgacagctgagnggacgagacacggctagtagtattactgtgacggagagactcgaacagtagaacgttaaaggggaaacgttaccgttttaggaattcgtcggacgggtaccgaagggaccacggtcgtacccaccgttctcttacacgtcctacgacgacggcctacgtccgtcctcccgcggcctccgtcnctaccgagtaccg

SEQ ID NO: 387477 - DNA, 629 bp, Homo sapiens
  misc_feature: GZ8MTXP02FXYW1.22.86.H09.1.454.CMB.2.raw
  modified_base (437)..(437): a, c, t, g, unknown or other
  modified_base (447)..(447): a, c, t, g, unknown or other
  modified_base (457)..(457): a, c, t, g, unknown or other
  modified_base (605)..(605): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggccgtccgggacgaagggggctgggaggtgggtggactaattatagtggtatgaagtggaaagtaaataaagactagtgtggactaccggtaggaacgggccgatttaccaacctatcctaccgaagaacgaacaactaccaaaagaacacgttctacgtttaccaccaaaatacgaacacgcctggagagggacggaagacgacggactaaggttntagtttacgngagagaaganactacgatagagaacgtaaaggtattgttagactcgtacgggacggaccgaaggtactacgtacgcctacgttctactcgaccgtcctaaccgaaccgtaaccggtccctacgtccccgttacccgtccccgtcggtccccgtacccncggtaccctacggaacggtacccg

SEQ ID NO: 387478 - DNA, 583 bp, Homo sapiens
  misc_feature: GZ8MTXP02F59NH.22.86.H09.1.454.CMB.2.raw
  modified_base (342)..(342): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctcctgtgcagcgtctggattcaccttcagtggctatggcatgcacgtggctcccgcaggcctccgggcaaggggctgggaggtggggtgcctaagttntagtggtatggaatggggaaattaaagtaaagacttagtgggtaggaccgttaccggtaggaaacggggtcccgtaagtttccaaccctatccttaccgaagaacgaaccaacctaccaaacgaactacttctacgtttaccaccaaatacgaacacgccgtaggaggacgcggaacggaccgaggactagttgttactacgtgtacgaagtagagtacgtacgactagtacgtaaaccgg

SEQ ID NO: 387479 - DNA, 684 bp, Homo sapiens
  misc_feature: GZ8MTXP02FQDD2.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgacgtactctcctgtgcagcgtctggtattcaccttcgaggtggctagtggcatgcacgtcggcctcccgcgaggcctccggggacgaagggggtctggggaggttcggggtgacctaaaagttgtagttggtataggaagttaggggaaaacgttaaaagtaaaacgtacgttaagttcgggtacgggtaccgtacccgggtttaggaaacggggtcccgtaacgttacccgaaccgtactaccgttaccgaaggtaacgaaccaaaccgttaacccaaaacgtaaaccctaaccttaccgtttacggtttaaccctaaccctaaaagttacgaaaccgacgtaccgtaggaacggacgggacggaacgggaccgtacgggactacggtagttacgttacgaggttcgaacgtaagtacgactacgacgagtacggtaaaccgg

SEQ ID NO: 387480 - DNA, 668 bp, Homo sapiens
  misc_feature: GZ8MTXP02JSV70.22.86.H09.1.454.CMB.2.raw
  modified_base (319)..(319): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgacgtactctcctgtgcagcgtctggattcaccttcagtggctagtggcatcgcacgtggcctccgcgaggctccggggnaacggggtctaggggaggtcgggtggaccctaagttagtagtggtatgaagttggggaaaattaaagtaaagtacttaagtcggtacggtaaccgtacccggtaggaaacgggtacccgtatttacccgaacccgtagttaccctacccgaaggaacgtaaacctaaaccttaccgaaacgtaaacctaccgttacgttacttttacccgtaaaccctaaaagttacggaaaacccgtacggacccgttagggaacggtacgggaccgggtaaacggaaccgacgggaccgtagttaggtacttaaccgtggtacgaaggagtagactacgaactagtacgtaaaccgg

SEQ ID NO: 387481 - DNA, 686 bp, Homo sapiens
  misc_feature: GZ8MTXP02IAE6E.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggctccgccaggctccgggcgaaggggctgggaggtgggtgacaattatagtggtatgagtaggaaagtaaataaagactagtgtggactccgtaggaacggcgtactaccacatcctacgagacgacaactccaaagaacctactacttcgtttaccaaccgtaaatcgtaaacacgcctgaacggacggacgacggaacgcggactaggtatagtacgtggtgacggagagtacgtcgaacgagtacgtaaacgtaaacgggaaagttctttaggactacgtacgggtacggacggtaaacggaacgtacgttacgggtacccaccgttacctccgtttaccgacgtacccccaccgtaaaccccggaaccggggtacccctaaccggttccccggttacccccggtttccccccgttggggaccccccgttccccgtccgggttacccgtacccgggtaaaacgggtacccccg

SEQ ID NO: 387482 - DNA, 596 bp, Homo sapiens
  misc_feature: GZ8MTXP02F4YN3.22.86.H09.1.454.CMB.2.raw
  modified_base (270)..(270): a, c, t, g, unknown or other
  modified_base (283)..(283): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtgggtggagtcggtgggggaggcgtggtccaggccgtggggacgtccctgagtacctctccgtgtgcagcgtntggattccacttnagtggctagtggcatgctacgtcggcctcccggccgagggcccgtacccggggagaagggggtctaggggaggtggggtgactaagttatagtggtatggtataggggaaacttaaagtaaagtcttagtggtaggtactcggagaacgggctatacgactatctacgaagacaacaactaccaaagactacttcttacgttactaacaaatacgaacacgtactaggaagggacgacggaacgggacgacggacgtaagtacgttacgttacgtggtaggaacgagacgtactacgacacgtagtaaaccgg

SEQ ID NO: 387483 - DNA, 591 bp, Homo sapiens
  misc_feature: GZ8MTXP02GQIIV.22.86.H09.1.454.CMB.2.raw
  modified_base (321)..(321): a, c, t, g, unknown or other
  modified_base (505)..(505): a, c, t, g, unknown or other
  modified_base (542)..(542): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctggggaggtccctgagactctcctgtgcagcgtctggattcaccttcagtggctatggcatgccactggcctccgaccaggcctcccggggnaagggggctgggaggtgggtggactaaattagtagtggggtaatgaacgtagggaaaagttaaataagggtacttagtagggtacggtaacctccgggtaggaaacggggccgtattaccgacctatccgtaccagacgacaacgtaccaaagaactacttctacgttactaccaaatcggaanacgctagacgaggcgagacgacggctagtgtattacngtacgacgagagaacgtacggaacagtagaacgtaacggggaactttcg

SEQ ID NO: 387484 - DNA, 630 bp, Homo sapiens
  misc_feature: GZ8MTXP02IDBHG.22.86.H09.1.454.CMB.2.raw
  modified_base (416)..(416): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccaggccgtggggacgtccctgacgtactctcctgtcgcagcgtctggacttccaccttcaggtcggctagtggcagtcgacctacgtcggcctcccgccgaggcccgtccggggacgaaggggtctaggggaggtggggtagactaaattagtagtggtaatgaagtagggaaagttaaataacgattaagnggtacgactcggagaaccggctatcactatccgacagaacaactaacaccaaagactactcttagtttacaaccaaatacaactacgcgtagaacggacggacgacggaacacggtactaaggtttcgaaacttacggttaggacggaacgaaggttaacgaacgttaacggactaaggtaccgtaaaacggtaaaccggggttaaatttccgg

SEQ ID NO: 387485 - DNA, 747 bp, Homo sapiens
  misc_feature: GZ8MTXP02GM6BU.22.86.H09.1.454.CMB.2.raw
  modified_base (253)..(253): a, c, t, g, unknown or other
  modified_base (258)..(258): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggagcgtggtccagcgtgggagtccctgacgctctcctgtgcngcgtngactcaccttcagtcggctagtcggacatgctacgtcggcctcccgcgacgggccgtacccggggagaacggggtcgtagggagggtggggtaccgacgtaaagtttataggttaggtagtaggaagttacgggggaaaattaaaaggtaaacgtacttaggtggtacgggtaaacccgttcgggtaaggaaaccgggtccgtaacgttcccgaaacccgtattccccgtaaccgaaacgaaaccgtaaaccctaaccttaaacccgaaaactaacccgtaccgttttaccttaccggttttacccgaaaacccttaaaagttaaccgaaaaccgcgtaaccgttagggaaacggacggggacccggtaaaagggccccggtaaaacggtaccgttaaaggttagttttaaacccggttacgggtacgttaaggaaccgggttaagtaaacgacggtaactaacgtaacgtaacggttaaaacccgggg

SEQ ID NO: 387486 - DNA, 697 bp, Homo sapiens
  misc_feature: GZ8MTXP02IE1E9.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggaggcgtggtccagcctgggaggtccctgagactctctgtgcagcgtctggacttcaccttcagtggctagtggcatcgcacgtggcctcccgccgaggccgtccggggacgaaggggccgttggggacggttggggtaggactaaagtttagtagttggggtaacttaggaagttaggggaaaagttaaacttaaaaggcttaagttggtacggtacttcccgggtaaggaacgggtccgtatttacaaccctagtaccgtaccaaggaacgaaaccaaaccgtaccgaaaacgtaactacctttccgttaacgtttacctaaccctaaaagttacggaaaacctacggacccgttaggaaacgggacgggaccggaaacggggaaaccgacggggaccgttaaaggttagttaaacgttttaccgaggggtttacggacggtaaacggaacgtaacgtaaccgg

SEQ ID NO: 387487 - DNA, 669 bp, Homo sapiens
  misc_feature: GZ8MTXP02FMW1Y.22.86.H09.1.454.CMB.2.raw
  modified_base (188)..(188): a, c, t, g, unknown or other
  modified_base (227)..(227): a, c, t, g, unknown or other
  modified_base (646)..(646): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcactggctccgccaggctccgggnaaggggctgggagtgggtgcaattatagtggtatgaagtggaaagtaaataaagactaagtgtacggactaccggtaggaacgggccgtacttaccacctatcctaccgaagaacgaaccaacctaccaaaacgaactacttacttaccgtttacctaaccgaaaatcgaaacacgacctggacgagggacggaacgacgacgggactagggttacgtaatttacgtggtagacggtaagaagtacgtacgaactagagtaacgtaaacgggtaaacgttcttttagaacgtttcgtacgggttacggggaacccgtaaggggtaccacgttcgggtacctacccgttcgtacttaccgacgtccctacccgaaccgtacgggaccccctggtcccgtccccttccccggcggtacccncccgtcgtaccaccggacggacc

SEQ ID NO: 387488 - DNA, 560 bp, Homo sapiens
  misc_feature: GZ8MTXP02F3WXK.22.86.H09.1.454.CMB.2.raw
  modified_base (281)..(281): a, c, t, g, unknown or other
  modified_base (387)..(387): a, c, t, g, unknown or other
  modified_base (517)..(517): a, c, t, g, unknown or other
  modified_base (549)..(549): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcgtctgattcacctcagtggctatgnatgcacgtggcctccgccgacggctcccggggacgaaggggcgtagggaggtcgggtggacctaagttatagtggtatgagtgggaaataataaagagttataggnggtactccggtaggaacgggcgtaatcaaccctatcctacgaagacgaaccaacttacccaaagaacctacgtactttcgtttacctaaccctaaatcgaacacgactgacggaggcggacgacgacggngattgtactacgtgacgcgagacgtacacganagacgtaacgg

SEQ ID NO: 387489 - DNA, 663 bp, Homo sapiens
  misc_feature: GZ8MTXP02JVDWT.22.86.H09.1.454.CMB.2.raw
  modified_base (130)..(130): a, c, t, g, unknown or other
  modified_base (188)..(188): a, c, t, g, unknown or other
  modified_base (391)..(391): a, c, t, g, unknown or other
  modified_base (452)..(452): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaancgtggtccagcctgggaggtccctgagactctcctgtgcagcgtctggattcaccttnagtggctatggcatgcactggctccgcaggctccgggcaaggggctgggagtgggtgcaattatatggtatgataggaaagtaaataaagactaatggtaggtacctccggtaggaaacgggccgatttccgaccaatcctaccgaagaacgaccaaacctaccaaaagaaccacttctacgtttcctaccaaatacgaaacncgacctggaagggacacgggacgggaacgacgggactaagggttagttaaactttaacggngtacggacggaagagacgtaacgaactagtaacgtaaccggtaaacgggtaaactttcgttagccttacggtacggggtacgggaccaagggtactacggtacgtcccgtaccgtccttaccgtaccgaccgtcccaacccgaaccggtaccggccctaccgttcccgttccccgtcccgcggtccccgtccgtacgcccgaccgacgccg

SEQ ID NO: 387490 - DNA, 643 bp, Homo sapiens
  misc_feature: GZ8MTXP02IJN1J.22.86.H09.1.454.CMB.2.raw
  modified_base (332)..(332): a, c, t, g, unknown or other
  modified_base (348)..(348): a, c, t, g, unknown or other
  modified_base (455)..(455): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcggtggtccagccgtgggaggtccctgacgactctcctgtcgcagtcgtctggacttctaccttgagtggctagtcggcatcgcacgtcggcctcccggcgacggccgtacccggggnggaacgggcgtagggnggtaggggtgactaagttatgtaggtatggatagggaaattaaaagtaagtactgtgtacgaccgtacgaggaacggtccattaccgactagtaccctacgaagtanaaacccgaactaccaaaacgtaactactttaccgttacgtttacctaaaccgaaagttaacgaaacgtacgtcgtaagaacggtacggaacggaccgggaacgccgggtaaacgtaggttaacgtacgttacgttagcggaaacggtaggaacgtaacgtacgaacgttaacgtaacggtaaaccggg

SEQ ID NO: 387491 - DNA, 524 bp, Homo sapiens
  misc_feature: GZ8MTXP02ILVZW.22.86.H09.1.454.CMB.2.raw
  modified_base (340)..(340): a, c, t, g, unknown or other
  modified_base (371)..(371): a, c, t, g, unknown or other
  modified_base (413)..(413): a, c, t, g, unknown or other
  modified_base (464)..(464): a, c, t, g, unknown or other
  modified_base (521)..(521): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcatggctcgccaggctcgggcaaggggctggagnggtgcaattatatggtatgagtagaagtaanaaagactaatgtaggatcgtagaaagggccgaattcactaanactccaagacgaacaactcccaaagaacaacctctagtttcacctaaaatnaacagactcgagagacgaggacgacgacgagtagtaagttactagtgagacgagaanacg

SEQ ID NO: 387492 - DNA, 660 bp, Homo sapiens
  misc_feature: GZ8MTXP02IXYY3.22.86.H09.1.454.CMB.2.raw
  modified_base (294)..(294): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctagattcaccttcagtggctatggcatgcactggctccgccaggctccgggcaaggggctggagtgggtggcaattatatggtatgatggaaataataaagactagtgtcggactccgnggaacggccgattcacatctccagagacaactccaaagaacactctcgtttacctaccaaatagaacacgctgagacggacgagaacacgggctagtagtattacgtgtgacgagtagatcgacagtacgacgtaaacgggaaacttcgtttagtagttaccgttacgacgggggaccctaaacggggactaaccgttcggggtaccctaaccggttctacccgtttacgaacccgtcccgttaacccgaaacccggtaaacgggggtccccctaaacggtttcccggttaacccccgtttccccccggttacggggacccccgtcccccggtttagcccccgttacccggaaacgggggtccccg

SEQ ID NO: 387493 - DNA, 535 bp, Homo sapiens
  misc_feature: GZ8MTXP02IJAR9.22.86.H09.1.454.CMB.2.raw
  modified_base (187)..(187): a, c, t, g, unknown or other
  modified_base (250)..(250): a, c, t, g, unknown or other
  modified_base (316)..(316): a, c, t, g, unknown or other
  modified_base (324)..(324): a, c, t, g, unknown or other
  modified_base (330)..(330): a, c, t, g, unknown or other
  modified_base (373)..(373): a, c, t, g, unknown or other
  modified_base (390)..(390): a, c, t, g, unknown or other
  modified_base (397)..(397): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttnagtggctatggcatgcactggctccgcaggctccgggcaaggggctggagtgggtgcaaattntagtggtatgagtaggaaagtaataaagactagtgtggactcggagaaggctatcaccatctacanagacaacncgaaanacactgtcttacacgaaatgaactagctgagaggcgagaccgngtcagtgtatactgcgngagaganacgacatagacgtaaggtaagtagtttagtatcgtcgtacggacgaacggacgtaacgtcgtccgaccgtctcttcacgcctaccaccgacgaccgcgtccgtcccgtcccgtccgccgccctcgccgcgacgacccg

SEQ ID NO: 387494 - DNA, 622 bp, Homo sapiens
  misc_feature: GZ8MTXP02IAVIF.22.86.H09.1.454.CMB.2.raw
  modified_base (187)..(187): a, c, t, g, unknown or other
  modified_base (224)..(224): a, c, t, g, unknown or other
  modified_base (351)..(351): a, c, t, g, unknown or other
  modified_base (393)..(393): a, c, t, g, unknown or other
  modified_base (412)..(412): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacttnagtgctatggcatgcactggctccgcaggctccgggnaaggggctgggagtgggtgcaattatagtggtatgagtaggaaagtaaataaagactaatggtaggactcccggtaggaacgggccgtattccaaccatctaccagagacaactccaaagaacactntcgttcacaaatgaacagcctgagacgcgagacacggcagtntatacgtgtgacgagagancgaacagtcgaacgtaacgggtaaagtcgttttaggacttcgtacggtacggggaaccgaaacggggtactaacgtcggtaccgtaccgtaccgttccgttaccgaccgtccgtaacccgtaaacggtaaccgggaccccgtacgttacccggttcccttccccccggtcggtccctaccccgtccgtcccgttaccgacgggtaacccg

SEQ ID NO: 387495 - DNA, 569 bp, Homo sapiens
  misc_feature: GZ8MTXP02FI1IE.22.86.H09.1.454.CMB.2.raw
  modified_base (244)..(244): a, c, t, g, unknown or other
  modified_base (253)..(253): a, c, t, g, unknown or other
  modified_base (284)..(284): a, c, t, g, unknown or other
  modified_base (370)..(370): a, c, t, g, unknown or other
  modified_base (548)..(548): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggngacaattanatggtatgatggaaataaataaagactatgnggactccgtgaaggccattcacatctccagagacaactccaaagaacacttctacgtttcctaccaaaatcgaaacagcctgaagnggacgagacacggcagtgtattacgtgtgcgagagatacgaacatacgaacgtaaacgggaaagtctttttgattcgtcgtaggggacccaaagggacacgtcggtacaccggttctcttacacgtaccctaccaaccgtaacgggaccccaacgtccgtccgtccccgtcggtcccnccctcgacctccgacggaccg

SEQ ID NO: 387496 - DNA, 647 bp, Homo sapiens
  misc_feature: GZ8MTXP02JREOS.22.86.H09.1.454.CMB.2.raw
  modified_base (239)..(239): a, c, t, g, unknown or other
  modified_base (271)..(271): a, c, t, g, unknown or other
tcagacatacgcgtcacgaccggtgctcgatttagtgctatagacttgggtttgggaggagagacccctccctgggctctgctcctcctcagcctcctcactcagggcacaggatcctgggctcagtctgccctgactcagcctcgctcagtgtccgggtctcctggacagtcagtcaccatctcctacactggaaccagcagtgatggttggtgtaataactatgtctctgtaccaangcaccaggacaacgccccagactcatctattnagctgtacaagtacgcggtccctcgacgggtaccctgtactccgcttctcgtcggacctacgtaacgtcgtacggaccaaaccgtacccgtccctacccgtagacccttacgtccgttacggtacggtcccgttaccgagggtcctaaggaaaacgtagtggtaaacggtccttagttaacgtttacgttacccgtgtcgttcggacttacttaaggttccgacgtacgggtccgtaccgttacggtacggtttacgggtcgggtacgggacggtaacggaccgtaggtcctacgggtaaccgtcggtacggacgtaccggccgaacgtcccgtccgacccgtcgcctcgtcctccgtacccctacctcgtacccg

SEQ ID NO: 387497 - DNA, 642 bp, Homo sapiens
  misc_feature: GZ8MTXP02HXW72.22.86.H09.1.454.CMB.2.raw
  modified_base (239)..(239): a, c, t, g, unknown or other
  modified_base (305)..(305): a, c, t, g, unknown or other
  modified_base (318)..(318): a, c, t, g, unknown or other
  modified_base (360)..(360): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgattgttggtgtataactatgtctctgtaccaanagcaccaggcaaacgccccagctcatctattatgctgtacaataagccggcctcgacggggtcccngactccgctttcncgtggctcctaagtctcggacaaccgacgtccctcctgaccnttccgtcgtcgggtcctcgacggtctaggaaagtgtcggaggtctaggtaattttacgttacttggtcctggtccctattagtttcgaacgtcggggtacctacgttaccgtacgtttgggggtcgttacggggacggggtacggaacccgaagggtcctacggtacccggtaccgtttaagggcccacggggtaaaccccgtacgggtacccctccccggtacccccggttcgtaccctaccgttcccgttcccgtttacccccggtccccttcctaacgg

SEQ ID NO: 387498 - DNA, 678 bp, Homo sapiens
  misc_feature: GZ8MTXP02GNOAW.22.86.H09.1.454.CMB.2.raw
  modified_base (230)..(230): a, c, t, g, unknown or other
  modified_base (647)..(647): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggccgtccgggngaaggggctgggagtgggtaggactaattagtatggtatggagtagggaaaagttaaataaaaggtactaagtggtacggtaccgtacccggtaggaacgggccgtaatttccaacctatcctaccaagaacgaccaaactacccaaagaaccacttcttaccgtttccacctaaaatcgaaacacgcctggaaggacggacggaacgaccgaacggactagttacgttatttaacgtggtaggacgaaagagtacgtacgaactaagtacgaacgttaaaccggggtaaagttcttttaggaacttcgtcgggttacggggaccgaagggaactcgttcggccttaaccgtcttaccgttcgaccgtcccacccgaaccgaacgggtcccctacgtcccgttccccttcccccggnggccctcccgttcgaccgacccgaggtaccc

SEQ ID NO: 387499 - DNA, 623 bp, Homo sapiens
  misc_feature: GZ8MTXP02IV2QH.22.86.H09.1.454.CMB.2.raw
tcagacatacgcgtcacgaccggtgctcgatttagtgctatagacttggagctctgggagaggagcccagcactagaagtcggcggtgtttccattcggtgatcagcactgaacacagaggactcaccatggagtttgggctgagtctgggttttcctcgttgctcttttaagaggtgtccagtgtcaggtgcagctgggtggagtcgtgggggagcgtggtccagcctgggaggtccctgagactctcctgtgcagcgtctggtatttccaccttcaggtggcctagtggcatgctacgtggcctcccgccgagggcccgtcccggggacgaagggggcctgggaggtggggtggaccctaagtttagtagtgggtataggaataggggtaaaattaaagtaaaacgactttagtgggtacggtaactcccgggttaggaacggtacccgtaattacccacctaatccctaccaagaacgacaacctaacaaacgaaacctacgttcttacgtttaccaccaaagtacggaacacgacgtggaaggagggaccgaaggaccgtagggactaggtacgttagtacgtgtagaacgtagacgtagtacgaactgtacgtaaagg

SEQ ID NO: 387500 - DNA, 770 bp, Homo sapiens
  misc_feature: GZ8MTXP02F4RUR.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctcccgccaggccgtccgggacgaagggggctagggaggtgggtagactaagttatagtggtatgagtaggaaagtaaataaagactagtggtacggactccggtaggaacggccgtattccacctatacctaccgaaggacgaacctaaccgtaccaaaagaacctaccttcgtttaccgtttaccctaaacctaaagtacgaaacacggtacctggaacggacgggacggaacggacgacgggactaggttacgttaagttaccgtggtacgtacggaagagtaacgtacgaaacgtaaggttacggaaaacggttaaacgggggtaaacgtttccgtttttaggacgttccgggttacgggtaaccgggggtaaacccaaagggggtaccctaacgggttaccggtacccgttaacccggttccttacccgttacgacccggttaccccctacccggaaacccggtaaaccggggtcccccttaacggttccccggttacccccgtcccccggtcggtaccccgtccccgtacgtacccgtaccggacggtaacccg

SEQ ID NO: 387501 - DNA, 630 bp, Homo sapiens
  misc_feature: GZ8MTXP02JFJYT.22.86.H09.1.454.CMB.2.raw
tcagacatacgcgtcacgaccggtgctcgatttagtgctatagacttgggtttgggggctttgcctgggctctgctcctcctcaacctcctcactcagggcacaggatcctgggctcagtctgccctgactcagcctcgctcagtgtccgggtctcctggacagtcagtcaccatctcctacactggaaccagcagtgatgttggtgttatactatgtctctggtaccaacagcaccaggcaaacgccccagactcatcatttatgctgtcaataagccggccctcacggggtccctgatcgcttctctggctcaagtctggacaacgcccgcctcctgacctatcctctcggggcctccgaggtctacgaagacgtcggaacggtcctagtatttattacttcgctcgtcttctagtttcgacgacggtccgtccgttaacgtcggtttacggggttcgggttaccggggacgggtaacggggtaccgaacggtacgtccggtaacccgttaccgtacgggtccgacggtaccccgaaacggcccgttacccggcccccgtccgggtcctacccgttccgttcccggtttacccccggtcccttccccgtccgtaccgtacggtttccg

SEQ ID NO: 387502 - DNA, 560 bp, Homo sapiens
  misc_feature: GZ8MTXP02H970M.22.86.H09.1.454.CMB.2.raw
  modified_base (230)..(230): a, c, t, g, unknown or other
  modified_base (378)..(378): a, c, t, g, unknown or other
  modified_base (418)..(418): a, c, t, g, unknown or other
  modified_base (492)..(492): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctggggaggtccctgagactctcctgtgcagcgtctggattcacctttcagtggctatggcatgcactggctccgccaggctccgggnaaggggctggagtgggtgcaaattatatggtatgatggaaagtaaataaaagactaatgtggactccgtgaaagggccgattcaccatctacagagacaaactcaaaagaacactctgtttactaccaaaatcgaacaagtcctgaanaggcgagacacggcagtgtatactgtgcgagagatcgaanatagaacgtaacggaagttctttagatcgtacgtacgggaccgaaaggacacgtacggtcaccgtctctacacnccctaccaacgaacggaccacgttccgtcccgttccccgtcggaccgtcccgtcgccgtacacggacg

SEQ ID NO: 387503 - DNA, 598 bp, Homo sapiens
  misc_feature: GZ8MTXP02FLO7M.22.86.H09.1.454.CMB.2.raw
  modified_base (254)..(254): a, c, t, g, unknown or other
  modified_base (330)..(330): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattanatggtatgataggaagtaaataaagactatgtggactcgtgaagggcgattcacatctcagagacaactaccaaanaactaactctagtttcaccaaatgaacagcctgagaggacgagacgacggcagtgtattactgtagcgtaagagatcgaacgataggaacgtaaacggggaaacgttcgttttagacttacgtcggtaggggacccgtaaagggactacgtacggtaccaccggttctacttccgacgtccctacccgaacccgaaacgggtcccctacgtcccggttcccttcccccgtacgggcccgtccccgtgcccgtaccggaacggtacccg

SEQ ID NO: 387504 - DNA, 743 bp, Homo sapiens
  misc_feature: GZ8MTXP02FK6R2.22.86.H09.1.454.CMB.2.raw
  modified_base (275)..(275): a, c, t, g, unknown or other
  modified_base (665)..(665): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtgggtggagtcggtgggggaggcggtggtccaggccgtggggacgtccctgacgtacctctcctggtgcagtcgtntggtacttccaccttcaggtcggactagtcggacagtcgactacgtcggacccgtcccggaccgacgggcccggtccgggacgggaaggggtcgtaggggtagggttggggtacgtattaaagtttagtacgttaggtagtaggaagttaaagggtaaaattaaaacgtaagagttaaggttgtaacgggtaccgttacgggagggaaaccgggttacctaattaccaccgtacgttaccgaacccgaaagtaaccaaacctaaacccgtaccgaaaacgaaccctttacttaccgtttacgtttaacccaaactaaacggtacaaaccgcggtaccgaggaacgggacggacgaacgggacgaacgggtataggttagtaaacgttcgngggtaacgacggaaggtaagttaaccgtaaccggaaacgtacggttaacggtaaaacggttaaaccggtagttttacg

SEQ ID NO: 387505 - DNA, 782 bp, Homo sapiens
  misc_feature: GZ8MTXP02JRC7E.22.86.H09.1.454.CMB.2.raw
  modified_base (280)..(280): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggacgtccctgacgctctccgtgtgcaggcgtcgtggacttccaccttnaggtcggctagtggctagtcgacctacgtcggcctccccggaccgaggggtccccgtcccggggacggaacgggggtccgtaggggagggtggggtggaacctaaagtttagtagtagggttataggtaagtaggggtaaaattaaagtaaaacgtacgttagttagggtacggtaccgttcccggggtaaggaaacccggggtacccgtaacgtttacccaacccgtaacttccccgtaaccgaaacgggtaaccaaaccctaaacccgtaacccgtaaaacggtaaaccccttacctttacccggtttaacccttttaacccccgaaaaagttaccgaaaacccgtacggtacccgtaagggacggtaaacggggacggaacggaaccggtaccggacgtagggtttaaacgttaacgtttccggtaggttcgggaacggtaaaggtacggtaaacggttacggaacgttacggtaacggtaacgggtttaaaaccgggg

SEQ ID NO: 387506 - DNA, 747 bp, Homo sapiens
  misc_feature: GZ8MTXP02HB1FH.22.86.H09.1.454.CMB.2.raw
  modified_base (261)..(261): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcgagtgctatggcatgcacgtggcctccgcgaggcgtccgggagaacggggctgggaggtgggtgactaagttntagtggtatgaagtagggaaagtaaataaagactagtaggtcggactacggtaggaacgggcctacttcacctatcctacgaagacaactaactaccaaaagtacctacttcttaccgtttaccaaaccgtaaaagtacgaaacgtacgtaccgtagggaacggaacgggaccggaagggacccgaacgggacgtaggttacgttaacgtttacggagggtaacggaggaagtaacgtaccgtacgaacgtaagtaacggtaacgggttaaacgggtatttcgttagtacgtcggtacggggtaaccgggaaacgtaacggtacctacggttaccggtacccgttaccgtaccttccggtaacccgaccccgttacccgaaaccccgggaaaccggtacccggttccccgttaaccggtttcccccggttacccccgttcccgggcccgtacccgtcccgaaccgtacccggacgaacccggcccg

SEQ ID NO: 387507 - DNA, 732 bp, Homo sapiens
  misc_feature: GZ8MTXP02GRCIU.22.86.H09.1.454.CMB.2.raw
  modified_base (456)..(456): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgccgaggccgtccggggacgaagggggctgggagggtggggtaggtactaaattagtagttaggtataggtaagtaaggtaaagttaaataaagtaactagtggtacggtaccgtccggtaaggaacgggtacctacgttaccaacctactccgtacgaagaaccgaaccaaacctaccgaaacgtaacctacttaccgttaccgtttaccaacctaaaagtacgaaacctacggtaccgngggaaggtaaccggggacggaaacgacgtaaccgggagtagttagttattaccggtggtacggacggaagagtacgtaccgaagtaaagtacgaaacgggttaaacggtaacgtttacgttagtacgtcgtacggggacgggtacgaaacggtcgtacggtcggtccctaaccgttcttccgtactcccgacccgtacccgaaacggaacccggtccaccgttccccgtcccgttaaccccgcgtacccgtcctcggacccttcggaaccggtccc

SEQ ID NO: 387508 - DNA, 565 bp, Homo sapiens
  misc_feature: GZ8MTXP02H65F0.22.86.H09.1.454.CMB.2.raw
  modified_base (543)..(543): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactcgtgaagggccgatcaccatctccagagacaactccaaagaacactctcgtttactaccaaatacgaacagcctgagaggacgaggacacggcagtgtatacgtgtgacgagagatcgacatcgaataacggggaaattcgttttagaattctcggtagggggaccgaaaggggactacgtggtacctaccgtctccttcacgcccttaccaaccgacgggcccagttcccggtacccgttccccgcggtcccncccgtgccctcggaacggaccg

SEQ ID NO: 387509 - DNA, 598 bp, Homo sapiens
  misc_feature: GZ8MTXP02IXE6R.22.86.H09.1.454.CMB.2.raw
  modified_base (228)..(228): a, c, t, g, unknown or other
  modified_base (282)..(282): a, c, t, g, unknown or other
  modified_base (290)..(290): a, c, t, g, unknown or other
  modified_base (318)..(318): a, c, t, g, unknown or other
  modified_base (324)..(324): a, c, t, g, unknown or other
  modified_base (388)..(388): a, c, t, g, unknown or other
  modified_base (402)..(402): a, c, t, g, unknown or other
  modified_base (569)..(569): a, c, t, g, unknown or other
  modified_base (582)..(582): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggcctccggganaagggggctgggaggtgggtggacaattagtagtggtatgatagggaaataaanaaagatangtgactccgtaggaaggcgatcacatcncaaganacaactacaaagaacacttctacgtttcaacaaatagaacacgtcagaggagacgagtacacgnagtagtattaacgngtcgagaagagatacgaatagtagaacgtaaacgggaagttcgttttagagttacgtaggtaccggggacgtaaacgggacgtaacgttaccggtaaccgttcgtaacttcgaccggtaccctaccgaaaccgaaccggacctacgtcccggttacccttccccggngcccgtccgtacnccgtcgaacgcaaccg

SEQ ID NO: 387510 - DNA, 570 bp, Homo sapiens
  misc_feature: GZ8MTXP02FS4GV.22.86.H09.1.454.CMB.2.raw
  modified_base (313)..(313): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtgggtggctaaattatatggtatgatggaagtaaataaagactatgtagactcgtgaaggcgattcacatcncagagacaactcaagaacactctgtttcctaccaaatacgaacagacctgaggacggcgaacggacacggcagtgtattactgtgacgagagatacgacagtagacgtaacgggtaaatctttagattcgtacgtaggggaccgaaaggggactaacgtcggtaccaccggttcttcgttccacgccctaccaacccgaacgggtaccccacttcccggtcccttcccccgtcggcccgccctgcccaccgacggcg

SEQ ID NO: 387511 - DNA, 725 bp, Homo sapiens
  misc_feature: GZ8MTXP02JHWSC.22.86.H09.1.454.CMB.2.raw
  modified_base (317)..(317): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtctggattccaccttcagtggctagtggcatgcacgtggcctccggcaggccgtccgggnaaggggctaggggcggtggggtgacctaagttagtagtgggtataggaatagggggaaacttaaaataaacggtacttaagtggtacgggaaccttccgggtagggaaacgggtcccgtaatttacccaacctacttaccgacccgaaaggtaacgaaaccctaaaccgtaacccggaaaagaaaccctacctttccttaacggtttttacccaaaccctaaaaaggttccgaaaaccgtaccggtaccgtaagggaaaccgggtagggaacccgggtaaacgggaacccgaaccgggggtaaccttaaacgggtttacggttaacttttaaaccgggtcggttaacggaacgggaacggttaaacgacggttacccggaaagtaacggtacggtttaaaaaccgggg

SEQ ID NO: 387512 - DNA, 734 bp, Homo sapiens
  misc_feature: GZ8MTXP02JCO0Q.22.86.H09.1.454.CMB.2.raw
  modified_base (231)..(231): a, c, t, g, unknown or other
  modified_base (259)..(259): a, c, t, g, unknown or other
  modified_base (280)..(280): a, c, t, g, unknown or other
  modified_base (316)..(316): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattccaccttcagtggctagtggcatgcacgtggctccgcaggccgtccgggnaaggggctgggaggtgggtgctaaattnagtggtatgatggaaataaanaaagactatgagactcggtagacggcattcacatcncagacgacactaccaaagaaccatcttacgtttaccaacaaaatcgaaacacgtacctggaacggacggacggaaacggtaccaacgggctaagtagttaacgttacgtaggtagaccggtaaaggacgtacgtaccgggaactaaggacggtaaccggttaaaaccgggggtaaatttacggtttttaacggagtttacccggtaccgggttaacgggggtaaaccccaagggggtaacccttacgggttacggtaaccccgtccgggtttaaccttcccgttaccgggaacccctcccgtaaacccccggaaaccgaaacccggggtcccctaaccgttccccggttcccccgttcccccggtcgggtaccccgcccccgtttacggcccccgtttacccggaacgggtaaccccg

SEQ ID NO: 387513 - DNA, 630 bp, Homo sapiens
  misc_feature: GZ8MTXP02I5U84.22.86.H09.1.454.CMB.2.raw
  modified_base (409)..(409): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcgaaggggctgggaggtgggtggacaattatagtggtatgataggaaagtaataaagactagtgtgacgtccgtggaaggccgattcacatctcaagacgaacaactaccaaagtaaccacttctcgtttacaccaaaatcgaaacagcctggagagggcgagacgacggcagtgtattacngtgacgagagactacgactagtagaacgttaaacggggaaattccgttttagacttccgtacgggtacggggaccgaaaggggacctaacggttcggtacctaccgttcctacggtttaccacggtcccctacccgaaaccgaaccgggtcccaaccgtttccccggtacccttccccccggtcggcccgtcccccgtgtcccgtaccggacggtaccccg

SEQ ID NO: 387514 - DNA, 712 bp, Homo sapiens
  misc_feature: GZ8MTXP02JNGMB.22.86.H09.1.454.CMB.2.raw
  modified_base (466)..(466): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggccgtccgggacaaggggctgggaggtgggtgactaattatagtggtatgaataggaaagtaataaagactagtggtacggactccggtaggaaacgggccgtatttccgacctatcctaccaaggacgaaccaaactaccgaaaagaacctaccttcttacgtttccaaccgaaaatcggaaacagcccgtaggaacgacgggacggaaggaccacgggtactagggttatacttaacgtggtacgngaaagactagtaccggaatagtaccgtaaacgtaaacggggaaatttcgtttagaacgttcgttacggggacggggaacccaaaggggtacctacggtcggtaccctaaccggtttctaccgtttaccgaccggtacccctaacccgaaccggtaaaccggggtcccctaacggtttccccggtacccctttcccccggcggtacccccgtcccggttacgccccgtaaccggaacggtacccccg

SEQ ID NO: 387515 - DNA, 566 bp, Homo sapiens
  misc_feature: GZ8MTXP02HSZBL.22.86.H09.1.454.CMB.2.raw
  modified_base (322)..(322): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctgagctctcctgtcgcagcgtctggattcacttcagtggctagtggcatcgcacgtggcctcccggcagggcctcccggggnaaggggctggggaggtggggtagacctaattagtagtggtatggaacgtgggaaaattaaataaagacttaagtggtaggacctcgtagacggcgattcgaccatcctacgagacgacaacctaccaaagaacctacttcttacgtttacaccaaaatcgaacagcctagagacggcgacgacgagggctaggttagtactacgtgtagaacgtaagagacgtcgaactagtacggtaaaccgg

SEQ ID NO: 387516 - DNA, 582 bp, Homo sapiens
  misc_feature: GZ8MTXP02H3NCZ.22.86.H09.1.454.CMB.2.raw
  modified_base (200)..(200): a, c, t, g, unknown or other
  modified_base (361)..(361): a, c, t, g, unknown or other
  modified_base (406)..(406): a, c, t, g, unknown or other
  modified_base (421)..(421): a, c, t, g, unknown or other
  modified_base (426)..(426): a, c, t, g, unknown or other
  modified_base (463)..(463): a, c, t, g, unknown or other
tcagacatacgcgtcacgaccggtgctcgatttagtgctatagacttgggtttggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacngtcagtcacatctacctacactaggaaccagcagtgattcggttgtagttaataactatgtctcctagtaccaacacgccaccgaggaccaaaccgccccctaagacctcatctaagtttatgcctagtacaaatacggccgcccctggaccgggtccccngtactcgtcttctcgtcgtcctaccaagtccgtacgaaccaaccncccggtccctcccgnacctntccgtcgcggcctcgagacgtagaagcgtggtacgtntagttaacttagttcgctacgtgtctagtcgttcgacgcgtcgtacgtacgtacggttcggtcggtacggacgggacggacgacgtcgtcgtaccgtacgtacgtacgacgaccgaccg

SEQ ID NO: 387517 - DNA, 654 bp, Homo sapiens
  misc_feature: GZ8MTXP02I6FD6.22.86.H09.1.454.CMB.2.raw
  modified_base (191)..(191): a, c, t, g, unknown or other
  modified_base (257)..(257): a, c, t, g, unknown or other
  modified_base (267)..(267): a, c, t, g, unknown or other
  modified_base (278)..(278): a, c, t, g, unknown or other
  modified_base (286)..(286): a, c, t, g, unknown or other
tcagacatacgcgtcacgaccggtgctcgatttagtgctatagacttgagctctggggagaggagcccagcactagaagtcggcggtgtttccattcggtgatcagcactgaacacagaggactcaccatggagtttgggctgagcgtggttttccgcgtaggctctttaagaggtgtccagtgtcaggtncagcgtggtggagtcgtgggggagcgtggtccagccgtgggacgtccctgacgactctcctgtcgnacgcgttcgngtactcactgngtgctagngcagtcgctacgcggtccgccgccgacgggtccgaccgggacggtaacgggtcgtagggtaggtgggtagacccgtaagttagtaggtggttataggtaagttacggtaaagtaaaacgtaaagtacgtaggtacggtacggtaaccgtacgggtacggtaacggaccgtactaccgacgtacgtccgtaaccgaagtaaccgaacctaaccgtaaaccgaaacgttaacctaccgtttaccgttacgtttaaccaaacctaaacgtacgaacgaccgtacgtaggaacggacgggacgtaacggacgacgtcgtacgtacgtacgtacgtagtagaagacgtacgacgacgtacgacgtacgtaacg

SEQ ID NO: 387518 - DNA, 684 bp, Homo sapiens
  misc_feature: GZ8MTXP02HVKSS.22.86.H09.1.454.CMB.2.raw
  modified_base (188)..(188): a, c, t, g, unknown or other
  modified_base (273)..(273): a, c, t, g, unknown or other
  modified_base (502)..(502): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcactggctccgccaggctccgggcaggggctgggagtgggtgcaattatatggtatgataggaagtaaanaaagactatgtggtactccggtaggaaacggggtcctattccacctatcctaccgaagacgaacctaaactaccaaagtaaaccacttctacgttttaccaccaaaatcgaacacgtccgtggaggacgggcggaacgggacacgggtactaggtagttaagtttacgtggtacgcggaagagactacgaactagtacgaacgttaacgggggtaaattcgttttaagnttacgttcggacgggggtaccgaaaggggacctacggtcggtaccctaccggttccttccttaccgacgtaccccgtaacccgaacccggtaaaccggggtcccctaacgtttccccggtaccccctttcccccggtcgggccccgtccccgttaccggcccgttaccggacggtaaccccg

SEQ ID NO: 387519 - DNA, 576 bp, Homo sapiens
  misc_feature: GZ8MTXP02JSWZR.22.86.H09.1.454.CMB.2.raw
  modified_base (226)..(226): a, c, t, g, unknown or other
  modified_base (253)..(253): a, c, t, g, unknown or other
  modified_base (339)..(339): a, c, t, g, unknown or other
  modified_base (363)..(363): a, c, t, g, unknown or other
  modified_base (423)..(423): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggnaaggggctgggagtgggtgactaattntatggtatgatggaagtaataaagctatgtgactccgtgaaggccgattcaccagtctaccgaagacgaccaactccaaagaaccnctctagtttccaccaaatcgaacngacctgacgaggcgtagacacgggacagtacgtagttacgtgtgacgagagatccgaaanagtacgtaacgtaacggaagttcgtttacgatcgacggtacgggacgaaggacgtcgtcgtcaccgtctcgtaccgacgtccctaccgaaccgaccggaccctacgtccgtaccccttcccgcggcccgtcccgtacgccgtaccgacggacg

SEQ ID NO: 387520 - DNA, 647 bp, Homo sapiens
  misc_feature: GZ8MTXP02G6YI2.22.86.H09.1.454.CMB.2.raw
  modified_base (241)..(241): a, c, t, g, unknown or other
  modified_base (275)..(275): a, c, t, g, unknown or other
  modified_base (312)..(312): a, c, t, g, unknown or other
  modified_base (378)..(378): a, c, t, g, unknown or other
  modified_base (411)..(411): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccggtctcctggacagtcagtcaccatcctcctacactggaaccagcagtgattggttggtgttataactatcgtctctgtaccangccaccagacaacgccccagactcatctatttangtctgtacaataacgccggtccctcgacggggtcccngactcgctttcgtcgtcgcctcaagtcgaccgtacgaaccgccggtacccttcccgtacgaccctntccgtcgtcgggcctaccgacgacgtagaacgntaggacgtcgtagtattacgtactgtctcgtactgtatttcgacgtcggtccgtacccgttacgtacggttcggggttcggttaccggggacgggtaaccgggtaaccgtaggtacccgtaccggttaacccggtccgttaccgggacctaccggacccgtaacggcccgttccccgacccccgtggttccctacccgtttcgtccccggttacccccgtccccgtccgtaacccg

SEQ ID NO: 387521 - DNA, 646 bp, Homo sapiens
  misc_feature: GZ8MTXP02HIQAA.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggaggtgggtggactaattatagtggtatgagtaggaaagtaaataaagactagtggtacggactccggtaggaacgggccgtattcaccatcctacgagacgacaactaccaaagtaaccacttctaccgtttacctacaaaatcgaacacgacctggacggaacggcggagaccgacggctaggtagttaacttacgtgtaggacgaagtacgacgtacgaacgtagtacggaaacgttaaacggggtaaattcgttttagacgttccgtcgggtacggggaaccaaggggactacggttcggtacctacccgtctcgtttaccgacgtccctacccgaaccgaccgggtccctacgttcccggttcccttccccggcggccctcccgtgcccgtaccgacggaccg

SEQ ID NO: 387522 - DNA, 597 bp, Homo sapiens
  misc_feature: GZ8MTXP02IAHNM.22.86.H09.1.454.CMB.2.raw
  modified_base (382)..(382): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggtccagccgtgggacggtccctgagactctcctgtgcagcgtctggattcaccttcagtggctatggcatgcacgtcggcctcccgccgaggccgttcccggggcgaagggggcctggggaggtggggtcggacctaagttatgtggtatgatgggaaattaanaaaaggtactagtggtaggacgtccgtaggaaacgggtccgtattaccgaactacgtcctaccagaacgacaactaccaaagaaccacttcttacgtttccaaccaaatgaacagacctggacgtacgggacgaacgacgtaacgggactaggtacttacgttaaccgtgtacggaacgaaggtaagacgttacggactaagtacgtaaaccggg

SEQ ID NO: 387523 - DNA, 589 bp, Homo sapiens
  misc_feature: GZ8MTXP02G9YWA.22.86.H09.1.454.CMB.2.raw
  modified_base (228)..(228): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggctccgggnaaggggctggagtgggtgactaattatatggtatgatggaaagtaataaagactatggtggactccgtaggaaggccgattcaccatcctccagacgacaactccaaagaacactctcgtttactaccaaatgaacagcctgagaggcgagacacggcagtgtattacgtgtgacgagagatcgaacagtcgaacgtaagggaaacgttctttaggacttccgtacggtagggggacccaaaggggtaccacgtcgggttaccaccgttctccgttacacgccctacccgaaccgaaacgggcccctaacgtcccgttacccttcccccgtcggccccgtcccgtgccctccgaacggccg

SEQ ID NO: 387524 - DNA, 644 bp, Homo sapiens
  misc_feature: GZ8MTXP02JVUE5.22.86.H09.1.454.CMB.2.raw
  modified_base (156)..(156): a, c, t, g, unknown or other
  modified_base (262)..(262): a, c, t, g, unknown or other
  modified_base (313)..(313): a, c, t, g, unknown or other
  modified_base (342)..(342): a, c, t, g, unknown or other
  modified_base (592)..(592): a, c, t, g, unknown or other
tcagacatacgcgtcacgaccggtgctcgatttagtgctatagacttgagctctgggagaggagcccagcactagaagtcggcggtgtttccattcgctgatcagcactgaacacagaggactcaccatggagtttgggctgagcgtggttttccncgttggctcttttaagaggtgtccagtgtcaggtgcagctgggtggagtcgtgggggaggcgtgggtccagccgtgggagtccctgagactctctgtgcagcgtcnggattcaccttcagtggctatggcatgcactggcctccgcaggctccgggnaaggggctgggaggtgggtcgactaattntatggtatggatgggtaaaataaacgtaaagacttaagtggtacggaaccgttccggtaggaacggggccgaatttccaacctactacctaccgaagacgaacctaaacctaccgaaaacgaaacctactacttacggtttacctaacctaaaagtaccggtaaaacacgtacccgttaggaaacggacgggaccggtaaacgggaaccgtacccggggaacgttaagggtacgttaaaccgtttaacgnggttaaccggacggaaacgggagtacggttacgaccgtaagtaaacccgggg

SEQ ID NO: 387525 - DNA, 754 bp, Homo sapiens
  misc_feature: GZ8MTXP02IL7TH.22.86.H09.1.454.CMB.2.raw
  modified_base (233)..(233): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattccacctttcagtggctagtggcatgcactggcctccgccaggccgtccggganaaggggctgggaggtgggtagactaattatagtggtatgataggaaataaataagatagtggtagtactcggtaggaacggccgtatcacctatctaccgagaacgacaactaccgaaagaacctacttcctttacgtttacccaaacctaaagttacgaaaccgtacgtaccgtagggaacggaacgggaccgaacggggaacccgacgggaactaggttacgtaagttacgtaggtacgacggtaggaagtaacgtacgaaactacggtaaacgaaccgggttaaacgggtaacgtttcgttttaagtacgttaccggttacgggtaccggggaaccgtaacgggtaacctaccggttacggttacccttaaccgttccgttaccgtttaccgaccgttacccccgttaaccgaaacccggtaacccgggtacccgttaaccgtttcccccgggttcccctttaaccccgggtccggtccccgttccccgtaccgtcccgttaccggaacggtaccccg

SEQ ID NO: 387526 - DNA, 614 bp, Homo sapiens
  misc_feature: GZ8MTXP02I4QST.22.86.H09.1.454.CMB.2.raw
  modified_base (269)..(269): a, c, t, g, unknown or other
  modified_base (272)..(272): a, c, t, g, unknown or other
  modified_base (279)..(279): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgcttctttttaagaggtgtccagtgtcaggtgcagctggtggagtcgtgggggaggcgtggtccagccgtgggagtccctgagctctcngtncagctcnggattcaccttcgagtggcttagtggcatgcacgtgggcctacccggccgaggccgtccggggacgaaggggtctggggaggtggggtcggtactaagtttagtagtggggttataggtagttacggggaaagtttaaaagtaaacgtatagttggtacggtacgtccggtagggaaggtcccgtattacacctatccaccgagaacgtacaactacaaacaacgtaactcttacgttacccaactaaagtacgaacacgcctaggaacggacggaacgacgggacaccgggataggttattaacgtcgtaggtacgagaacggtagaacgtacg

SEQ ID NO: 387527 - DNA, 677 bp, Homo sapiens
  misc_feature: GZ8MTXP02INYOD.22.86.H09.1.454.CMB.2.raw
  modified_base (226)..(226): a, c, t, g, unknown or other
  modified_base (249)..(249): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcagtctccgggnaggggctggagtgggtgcaattntagtggtatgagtaggaaagtaaataaaggtactagtagtggtaacgtccgtaggaaacggtccgattccacctatcctaccaagtacgaaccaactaccaaagaacctactcttaccgttaccacctaaatacgaacagcctgaaggaggccgaagactaggactacgtagttatacgtgtgacgtagagatacgaacagtacgtaaacgtaacgggtaaacgttcgttttacgtacgttacgttacgggttacgggggaaccggtaaacggggtacctaaaccggttcggttacccgtaacccgttccgttaccgtttccgtacccgtacccgttacccgaaacccggtaccggacccgtaaccgttcccgtcccgttaaccccgtcggtaccccgtcccgttacgcccttaccggaacggtcccg

SEQ ID NO: 387528 - DNA, 839 bp, Homo sapiens
  misc_feature: GZ8MTXP02JIFFN.22.86.H09.1.454.CMB.2.raw
  modified_base (654)..(654): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgtttgcttttacgtttaaggtaggttcgtaccgtaggttcgtacggtagggtcgacgacggtcggttgggggtagggtacgggttcgggggtagggggggacgggtcgggttcgggtaccggacggtccgggtagggggtaccggttcccgtaggaacgtaccgttcctccggttggtcgacgtacggtccgttcgtaggttaccttacccttaccgttacggtaggttccggtacgttaggtcgggactacgtcggtacctccggtcggccccgtccccggacggtaccgggtcccgggtccggggaacgggtaacggggtcgtaaccgggggtggggttaggggtacgtaaagttaaagttagttaaggttgggtacgtaaggtaggtaaagtaaagtaaaagtaaacgtaagttagtcgggtaaacggtaccgttacgggtaaagggacccggggtactacgtacctaaccgtntacccgtaacgtaaaggaaccaaacgtaaaccccgtaacaaaaccgtaccttacgttccttaccgtttacccaaaacttaagaccctaagccggtacgtaggacggggacggaacggacggaacgtcgggtaacttagggtaataaccgttaaggtcgggacgaggacggttaacgaccgtaacg

SEQ ID NO: 387529 - DNA, 701 bp, Homo sapiens
  misc_feature: GZ8MTXP02HSHZS.22.86.H09.1.454.CMB.2.raw
  modified_base (188)..(188): a, c, t, g, unknown or other
  modified_base (227)..(227): a, c, t, g, unknown or other
  modified_base (279)..(279): a, c, t, g, unknown or other
  modified_base (328)..(328): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttnagtggctatggcatgcactggctccgccaggctccgggnaaggggctgggaggtgggtgactaattatagtggtatgagtaggaagtaaanaagactatgtaggacctcggtagaaacggccgtatcacaatcctacganagactaactcaaagtaaccactcgttacttacctaaccaaatcgaaacacgctgaggaggacgtagacacggactgtagttatacgtgtgacgagagatacgacagttcgaacgtaacgggtaaagttctttagtacttcgttacgggtaccggggacccgaaaggggttaccctaccggttacggtaaccccggtaccgtttacccgttaccctttcccgaaccggtttccccctaaaccccgaaacccggggaaaacccggggtcccctaaccccccgggtttcccgggttacccccgttttaacccccccggtcgggaacccccgtcccccgttcggtaaaccccgtcccgggtaaccggtaacccccgg

SEQ ID NO: 387530 - DNA, 719 bp, Homo sapiens
  misc_feature: GZ8MTXP02F11SI.22.86.H09.1.454.CMB.2.raw
  modified_base (649)..(649): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctagtggcatgcacgtgcctccgccaggcgtccgggagaggggctgggagtgggtgctaattatagtgtatgtagtaggaaagtaaactaaagactagtggtcggacgtccggaggaacgggcctacgttaccaccctatccgtaccgaggtaacaaccgtaactaaacccaaacgaacctacccttcttaccggtttacctaacccgaaattacgaaaccgtacgtccgtaggaaacgggacggggtacggaaaccgggaaccgtaacggggtaccctaaaggttacgtttaaacgtttaccgtgggttaggacgaaaggagttacgaccgtacgtaagtacgggtaacgttaaacgggggtaaacttccgttttagacgttaccgtcgggtacgggaccgagggacgttcgtacggtccaccgttctcctacaccggtcccaccggaaacccncgggtaccccctgtcccggttaccccgtccccgtcggtcccctccgtaccgtccgtaccgacggtacccc

SEQ ID NO: 387531 - DNA, 740 bp, Homo sapiens
  misc_feature: GZ8MTXP02GT0DG.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagccgtgggaggtccctgagactctcctgtgcagcgtctggattcaccttcgagtggctatggcatgcactggcctccgccgaggccgtccggggacgaagggggtctagggaggtggggtggactaagttagtagtggtatggaataggaaaataaacgtaaagactagtagtacggtactaccggtaggaaacggccgtaattaccgacctagtcctaccgagaacgaaccaactaccgaaagtaacctacgttctccgtttacctaaccgtaaaagtacgaaacgtacgtaccgtaggaacgggacggaccggaacgaaccgtacggacgtagtacgttaattacggtgtacgagaaggactacgtacggaacagtaacgtaacggtaaacggggtaaatcgttttagaacttcgtacgggtacggggaacccgaaagggaccgttaccgtcggtacccgtaccgtttctacccgttacgaccgtacccccgtacccaaaccgggtaaacccggtcccgtaaacggttcccccggttaccccttcccccggcggtcccccgttacccgtccgtcccgtaacccggacggtaacccccgg

SEQ ID NO: 387532 - DNA, 762 bp, Homo sapiens
  misc_feature: GZ8MTXP02IVWQV.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggctccgccaggcgtccgggcaaggggctggagtgggtggacaattatagtggtatgataggaaagtaaataaagtactaagtggtaggactccgtggaaggccgtattcaaccatcctaccagacgacaactaccaaagaaccactcttacgtttctacctaaaatacgaaacacgcctaggacgaagggccggaacgaccgaacgggactaaggtagttaagttactggtacggacggaaaggaaacgtagtaccgaaaccgtaaaggtacggtaaacggttaaaacgggggtaaaaacgtttccgttttttaggaaacgtttcccgttacgggttaccgggggaaaccccgaaagggggtaaccctacggtttacggggtacccttaaccgggtcctttcccgtttacgaaccgttaccccgttacccgaaaccccggttaaaacccggggccccttaaccggttcccccggtttacccccgttccccccggtcccggggtccccgttaccccccgtcggtacccccgttaccggaaaccgggtaccccgg

SEQ ID NO: 387533 - DNA, 619 bp, Homo sapiens
  misc_feature: GZ8MTXP02G03WG.22.86.H09.1.454.CMB.2.raw
  modified_base (532)..(532): a, c, t, g, unknown or other
  modified_base (598)..(598): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggaggtcggtgggggagcggtggtccagccgtggggacggtccctgagacctctcctgtgccgagcgtcgtggtacttcctacctcagtggctagtggcatgcacgtggcctcccgccgagggtccgtccggggagaaggggtcgtgggaggtggggtacgtactaagttagtagtggtataggagtaggaaagtaaataaacgatagtgtacggcgtcggtaggacgggtctacgtaccactactcccgtacgaaaggacaaaccaactaaccgaaacgtacctaacttccttacgttactaaccgtaaancgtaaacgcgtccgaagacgggaggacggaacggaccgaccggtacgtaggtagttaacgtacggngttaggcgacgagtactacgg

SEQ ID NO: 387534 - DNA, 552 bp, Homo sapiens
  misc_feature: GZ8MTXP02F9C2J.22.86.H09.1.454.CMB.2.raw
  modified_base (295)..(295): a, c, t, g, unknown or other
  modified_base (316)..(316): a, c, t, g, unknown or other
  modified_base (318)..(318): a, c, t, g, unknown or other
  modified_base (403)..(403): a, c, t, g, unknown or other
  modified_base (408)..(408): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgtaggctcttttaagaggtgtcagtgtcaggtgcagctggtggagtcgtgggggaggcgtggtccagccgtggggacggtccctgagactctcctgtgccagcgtctggatcactcagtgctatggcatgcactgctccnccacgcgtccggcgagggcgngnggtgggtgcgtatatatgtagtagagtggaagtaaagtaaagtatagtagtaggacgtaccgtagaaggcggattaccacactcncaganaacacacaacaacactactcttcttaacaaacgtacgaacacgaccgagaggaacggacggacggacgaccggacgtacgtacgtacgttaacgtcggttacgaacggacgtaacgtaggtaccgaaacgtacgtacgtaacgg

SEQ ID NO: 387535 - DNA, 737 bp, Homo sapiens
  misc_feature: GZ8MTXP02HW8FW.22.86.H09.1.454.CMB.2.raw
  modified_base (392)..(392): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagtcgttgggttttcctcgttgcttcttttaagaggtgtccagtgtcaggtgcagctggtggagtcgtgggggagcgtggtccagccgtgggagtccctgagactctccgtgtgcagcgtcgtggacttcctaccctttcgaaggtcggtctaaggtcgggacagtcgaccgtaccgtcgggcctcccggccgtacgggcccgtccggggacgtaaggggccgtaggggngggtcgggtgtactaagtttagtaagtgggttaatagggtaaagtaggggtaaaattaaaagtaaaacgtacgtaagtggtacggtacgtccgggtaggaacgggtccgtacttaccacctacgtcctaaccgaaggtaaccaaacctaaacgttaacccaaaacttaacctaccttaccgtttacgtttaaaccctaaacctaaaagttaccggaaacctacggttacccgtaagggaaacgggacggggaaaccggaacgggaaaccgtaccggggtacttaacggggttaactttaaacggtcgtacgggtacgaccggaaaggtaacgtaacggtaaaccg

SEQ ID NO: 387536 - DNA, 691 bp, Homo sapiens
  misc_feature: GZ8MTXP02H7H5J.22.86.H09.1.454.CMB.2.raw
  modified_base (268)..(268): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagtccgtgggacggtcctgagcttctcctgtcgcaggtcgttcgnggtactttccaccgtttgagttggactagtcggctagtcgcctacgtcggacccgtcccgcgtacgggccggtccggggacgacggggcgtggggacggtggggtacgactaagttagtagtaggttagtaggattaggggaaaattaaagtaaagcttagtgggtacggtacccgttaccgggtaggaaccggggtacctacgttacccgaaactactaccgtaccgaagaaccgtaccaaaccgtaaccaagtaaaccctacgtttaccttacgtttaacccaactaaacgtaccgaaacgtcgtaaccgtacgggaagaacgggaccgtaaagggaccgtacgggacttagggttaactagttaccgttggacggtaacgaaggtagaccgttacgaacgtagtttaacgggtaaaccgg

SEQ ID NO: 387537 - DNA, 577 bp, Homo sapiens
  misc_feature: GZ8MTXP02II0BI.22.86.H09.1.454.CMB.2.raw
  modified_base (321)..(321): a, c, t, g, unknown or other
  modified_base (356)..(356): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagctctcctgtgcagcgtctggattcaccttcagtcggctagtggcatgcacgtcggcctcccgccgaggccgtcccggggngaaggggcgtaggggaggtggggtgactaaagttntagtggtatagagtacggggtaaataaactaaagacttagtggtggtaacctccggtagacgggcgtattccaccatccacagacgaccactacaaagtaacacttcgttcgtttaccaacctaaagtcgaaactcgtccaggtagacgggacgaaggacccaggacctaggtcgttactagttgagaacggagagtacgtacgacacgtaggtaaaccgg

SEQ ID NO: 387538 - DNA, 753 bp, Homo sapiens
  misc_feature: GZ8MTXP02II1PZ.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacttcagtggctatggcatgcactggctccgccaggctccgggcaaggggctgggaggtgggtgctaattatagtggtatgaataggaaagtaaataaagactaagtgtacggactccggtaggaacgggtccgtattaccacctatcctaccgaagaacgaccaaactaccgaaagaacctacttacttacgtttacctaaccaaaagtacgaaacacggtaccctaggaaacggaacgggacggaacgggaaccgacgggtactaaagggtttacgttaaacgttacgtaggtacgaacgggtaaggtaacgtaacgtaccggaaactaacgttacgggaaaacccgtttaaaagggggaaacttttcgttttaacggtaacgttccggttacgggtaccggggaacgaaacggggtaaccttacggtcggttaaccctccggtttactaccgtttacgaaccgtccccgttaaccgaaaccgggtaaacggttccccttacggttcccgtttccccgttaacccccgttcggggcccctacccgtacgtcccgtacccggaggacccg

SEQ ID NO: 387539 - DNA, 683 bp, Homo sapiens
  misc_feature: GZ8MTXP02GBPTM.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggtccagccgtggggacgtccctgacgctctcctgtgcagcgtctggacttcaccttcaggtcggctagtggcatgctacgtcggcctcccgccgacggcccgtcccggggacgaacgggggtcgtaggggacgggtggggtacggacccttaaagtttagtaagttggggttaattaggaagttaggggaaaagttaaaactaaaggtacttagtacgggtagggtaacccgttaccgggtagggaaacgggtccgtaacttaccgtaacctacgtacctacgacgaacgaacgaacctaccgaaacgaactaccgttacttacgtttaccaaccgtaaagtacgaacgtacgaccgtaggaacgggaggaccggacggaaccgaacggcgtaaggttactaacgttacgtggtagaacggaacgtaacggtaacgtaccgaacgtagttacggtaaaacccgg

SEQ ID NO: 387540 - DNA, 560 bp, Homo sapiens
  misc_feature: GZ8MTXP02FWD0Q.22.86.H09.1.454.CMB.2.raw
  modified_base (261)..(261): a, c, t, g, unknown or other
  modified_base (318)..(318): a, c, t, g, unknown or other
  modified_base (337)..(337): a, c, t, g, unknown or other
  modified_base (346)..(346): a, c, t, g, unknown or other
  modified_base (354)..(354): a, c, t, g, unknown or other
  modified_base (378)..(378): a, c, t, g, unknown or other
  modified_base (466)..(466): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctgagctctctgtgcagcgtcnggattcaccttcagtggctagtggcatgcactcggctcccgcaggccgtcccggggnaaggggctgggagtggggngactaattntagtgtangatggaaataaactaaagcttagnggtgactcgtagaaggccattccacatctacagacgacaactaacaaagaacacttcttagtttaccaaccaaagtcgaaacacgtcngaagacgggacgaaagggaccacggacgtagttagttaacgttacgtggtagaacggaagacggaacgtccgaagtaacgtacggtaaaccggg

SEQ ID NO: 387541 - DNA, 817 bp, Homo sapiens
  misc_feature: GZ8MTXP02IRZEN.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggcctccgccgaggccgtccgggacgaaggggcgtgggaggtgggtggactaattagtagtggtatgaagtaggtaaaagtaaataaagtactagtggtacggtacctaccgggtaggaaacgggtccgtaacttccaaaccctacgttaccgtaccgaaacggtaaaccgaaaccctaaaaccctaacccgaaaaacgtaaacccctaactttaccgtttaccgtttttaccccaaaaccgtaaaattaacggaaaccgtacggtacctacggggaacggggaaacgggaccgggaaaccggaacgaacgggacgtaggttagttaacgtttacgtgggtacgaagggtaaagaacggtactaaccgaacgtaagtaccggtaaaccggttaaaacggggtaaactttcgttttaacgaacgtttcccgtacggggtaccgggggaaacccgtaagggggaacccttacggggttcgacccgtaccgttcctaccgttccgacccgtaccctaacccgaaaccggtacccgggacccttaccgttccccggttccccgttcccccgtcggcccccgtccgtccgtaccctaccggggaccgaacccg

SEQ ID NO: 387542 - DNA, 699 bp, Homo sapiens
  misc_feature: GZ8MTXP02HM9SV.22.86.H09.1.454.CMB.2.raw
  modified_base (623)..(623): a, c, t, g, unknown or other
  modified_base (632)..(632): a, c, t, g, unknown or other
  modified_base (677)..(677): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcgagtggctagtggcatgcacgtggcctccgccgaggccgtccgggacgaagggggctgggaggtgggtggactaagttatagtggtatgagtaggaaagtaaataaagtactagtggtacggtactccggtaggaacgggccgtacttaccaacctactcctaccgaagaacgaacctaacctaccaaacgaacctaccgttcttaccgtttacctaaccaaattacgaactacgtaccctgggaacggacggacggaacgggaacccgaacgggcgtaaacgttagttaacgtttaacgtgggtcggaacggaagtacgacgttcgaaacgtgtaaacggtaaaccgtaaaacggggttaatttcgttttagtaacgttccggtacggggtacgggaacctaaaggggcccttaaggtcggtacctaccgtntccgttacncgtacccaccgaccggaacgtccacgttcccgtcctcccgcgccncccgtagccgtaccgagtcccg

SEQ ID NO: 387543 - DNA, 524 bp, Homo sapiens
  misc_feature: GZ8MTXP02ISDU4.22.86.H09.1.454.CMB.2.raw
  modified_base (311)..(311): a, c, t, g, unknown or other
  modified_base (320)..(320): a, c, t, g, unknown or other
  modified_base (322)..(322): a, c, t, g, unknown or other
  modified_base (331)..(331): a, c, t, g, unknown or other
  modified_base (391)..(391): a, c, t, g, unknown or other
  modified_base (452)..(452): a, c, t, g, unknown or other
  modified_base (494)..(494): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcgtctggattcaccttcagtggctatggcatgcactggctccgcaggctcccgggnagggctggngnggtgctatntatggtatgatgggaaataataaagactagtgtggactcgtagaggcgatcacatcacanacgacaactacaagaactacttctagtttccacctaaaagtcgaaacagtacctaggaagnggtacggacggacgacggcaacgttaggtactaacgtgtagnggtagaggtactacgacagttacgaaacgg

SEQ ID NO: 387544 - DNA, 598 bp, Homo sapiens
  misc_feature: GZ8MTXP02IWCXL.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggaggcgtggtccagccgtggggaggtccctgagactctcctgtgcagcgtctggatcaccttcagtggctatggcatgcactggctccgccaggcctccgggcaaggggtctgggaggtggggtgactaagttatagtggtatgagtgggaaagtaaataaagataagtggtacggaccccggtaggaacggggccgtattccaccgtatcctaccagaagaccaaacctaccgaaagaacctacttctacgttttacctaacctaaagtcgaaacgacgtaccgtaggaacggaggacggaacgggaaccgacggacgtacgttgttaattaacgtggtacggacggtagacgtacgtacggaacg

SEQ ID NO: 387545 - DNA, 606 bp, Homo sapiens
  misc_feature: GZ8MTXP02I416E.22.86.H09.1.454.CMB.2.raw
  modified_base (189)..(189): a, c, t, g, unknown or other
  modified_base (281)..(281): a, c, t, g, unknown or other
  modified_base (397)..(397): a, c, t, g, unknown or other
  modified_base (412)..(412): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggcctccgccaggctccgggcaaggggctgggaggtgggtggactaaattatagtgtatgaatgggaaataanaaagatatgtggactccggtagaaggcctatccacaatctcgaagtacgacaaactcgaaataccatctacgtttacaaccaaagtcaactagctgacgaggacgagaccgagtanaggttatacttaggngagagagtagacacgaatagtagaacgtaaacggtaagttacgttagtagtacgtacggtacggacggaacggacgtacgtacgtaccgtaccgtctcctacgaccgacccgtacccgaaccgaaccggtacccgtacccgtacccgtcccgtccccgtcccgacccgtcccgtccgtaccgtaccgacgaccg

SEQ ID NO: 387546 - DNA, 616 bp, Homo sapiens
  misc_feature: GZ8MTXP02H88GO.22.86.H09.1.454.CMB.2.raw
  modified_base (269)..(269): a, c, t, g, unknown or other
  modified_base (289)..(289): a, c, t, g, unknown or other
  modified_base (321)..(321): a, c, t, g, unknown or other
  modified_base (345)..(345): a, c, t, g, unknown or other
  modified_base (434)..(434): a, c, t, g, unknown or other
  modified_base (480)..(480): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtcgtgggggaggcgtggtccagcctgggaggtccctgagactctcctgtgcagcgtctggattccaccttgagtggctatggcagtgcacgtggcctccgccgagggccgtccggggagtaaggggctgggaggtgggtgctaatatgngtatgatggaaataataagntatggtgacctcggtagaacggctatcacgtntcacagacacaactacaagaaccncttactcgttaccaactaatacgaacagcctgggaacggacggacgaacgacgtcgggactagttacgtaattggtgacgagaggactntacgactagtcgaagtaaccggggtaatttccgttagactttcggngtaccggggaacaaggactcgtggtacccctgttccttacgccaacggtccctaccgaaacccgtcggaccctcggtttcccgtcccccgttcccgcggggttacccctcctccggacccgtaccgaaggcccccg

SEQ ID NO: 387547 - DNA, 742 bp, Homo sapiens
  misc_feature: GZ8MTXP02IOWTP.22.86.H09.1.454.CMB.2.raw
tcagacatacgcgtcacgaccggtgctcgatttagtgctatagacttgggtttgggctgagctggggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgcaggctccgggcgaggggcgtgggggtggtggctaattatagtggtatgagtaggaaagtaaataaagactatggtaggactccggtaggaagggccattcaccatctacagaacgaccaactacaaagacactctacgttaccaccaaatcgaaacacgaccgtagaggaacggacgaacggacgaccggacgtaagttagttaagtttacgtggtaggacgaagtaacgtacgtacgaaacaagttacggaaacggttaaacggggtaaacgtttaccgtttttaggaaacttttcggaccgggttacggggggaacccaaaagggggtacctaacggttccgggtaacccttaccccgggttcctttaccgttacccgtaaccgtaccccgtttacccccggaaaaccggtaccccggggtaccccttacgggtttcccccggttcccccgtttaccccccgcggggtcccccgtccccgtttaccggaccccgttacccggacggtaaccccggtacccccg

SEQ ID NO: 387548 - DNA, 655 bp, Homo sapiens
  misc_feature: GZ8MTXP02GQ2ZM.22.86.H09.1.454.CMB.2.raw
  modified_base (323)..(323): a, c, t, g, unknown or other
  modified_base (348)..(348): a, c, t, g, unknown or other
  modified_base (371)..(371): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctcccgccgaggcgtccgggcgaaggggctgggaggtgggtgactaaattatagtggtatgataggaaagtaaataaagactagtggtggactcggtagaacgggccattcacntctacagacacaactacaaagaacncttctctttacactaaatgaacngctggagaggcgagaccgaggactagtgttatacgtgtaggcgaagagactacgacgtagtacgaacggttaaaccgggaaagttccgtttagtacgttacgttaccgggttacggggacccgtaaacgggaccgtacggttcggtacccgtaaccgttccgtaccgtttaccgaaccgtccccgttaacccgaacccgggaaaccgggtccccgtaacgttccccggttaccccgtttccccgttccggcccgtcccgtaccgccgttaccggacggtacccg

SEQ ID NO: 387549 - DNA, 656 bp, Homo sapiens
  misc_feature: GZ8MTXP02F95TQ.22.86.H09.1.454.CMB.2.raw
  modified_base (189)..(189): a, c, t, g, unknown or other
  modified_base (230)..(230): a, c, t, g, unknown or other
  modified_base (247)..(247): a, c, t, g, unknown or other
  modified_base (263)..(263): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttnagtggctatggcatgcactggctccgccagggcctccgggnaaggggctggagtgggngacaattatatggtangataggaataataagactatgtaggactccgtgaacgggccgattccacatctaccagacgacaactaccaaagacactctagtttccacaaatcgaacacgccgtgagacgggacgacggacacggcgtagttacgtattacgtgtagcgagtacgatacgacagtacgacgtaaacgggaaattctttagacttcgtcggacggggaccgaaggggtacacggtcggtaccgtaaccggtcgttacgttaccaacggtccccttaaccccggaaaccggtaaaccgggggtaccccctaaccgttccccgggggtttaacccccttaaccccccggtacgggttacccccggcccccgtacggttccccgtaacccggacggtaaccccgg

SEQ ID NO: 387550 - DNA, 520 bp, Homo sapiens
  misc_feature: GZ8MTXP02FG45K.22.86.H09.1.454.CMB.2.raw
  modified_base (342)..(342): a, c, t, g, unknown or other
  modified_base (492)..(492): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtcccctgagactctcctgtgcagcgtctggattcacttcagtggctatggcatgcactggctccgccaggctccggggcaagggggctgggagtggggtggccaattanatggtatgatgggaaagtaaataaagactatgtggactccgtagaaagggccagttcaccatcctccaagacgacaactaccaaagaacactctcgtttacaccaaatgaacagcctgagaggacgaggacacggcaggtcgtacttacnggtacgcgagagactcgacataggaacg

SEQ ID NO: 387551 - DNA, 584 bp, Homo sapiens
  misc_feature: GZ8MTXP02IJ4PT.22.86.H09.1.454.CMB.2.raw
  modified_base (315)..(315): a, c, t, g, unknown or other
  modified_base (374)..(374): a, c, t, g, unknown or other
  modified_base (384)..(384): a, c, t, g, unknown or other
  modified_base (388)..(388): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattatatggtatgatggaaagtaataagactatgtggactcgtgaaggcgattcaccatctaccaganacaactcaagaacactctgtttcaccaaatgaacagcctgagaggcgagacaggcagtntatactgcgngagngatcgactagtagacgtaacgggaaagttcttttagacttcgtcggtacggggacccgaaaggggtacctaacgttcgggtacctaacccggttcttccgtttacacggcccctaccaacccggaaacgggcccctaaacgttcccggttacccttcccccgtcgggccctcccgtggcccttaccgagggacccg

SEQ ID NO: 387552 - DNA, 820 bp, Homo sapiens
  misc_feature: GZ8MTXP02JMMAM.22.86.H09.1.454.CMB.2.raw
  modified_base (231)..(231): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcacgtggctccgcgtaggccgtccgggngaaggggctgggaggtgggtgactaattagtagtggtataggagtaggtaaagtaaataaagacttagtggtacggacgtccggtaggaaacgggtccgtaagtttaccaaccgtaacttccgtaaccgaaggaaccgaaacctaaacccgtaaccgaaaacggtaaccctacgttccgtttaccgtttttaccaaccgtaaaagtacgaaaccgtacgacccgtaggggaacggaaggggaccgaacgggggtaccgaacggggtacgtaaaggttacgtttaacgttacgttacggggagacgggtaaggaacgtaccgttaacggaacctaggtaaaccggtaacgttaaaaccggggggtaaattttacggttttacgacgtttacccggtaccgggggttaacggggaaacccggtaaacgggtaaccgtacggttaccggtacccgttacgtccgttacccgtactacccggaccccttaacccgaaacccgggaaccgttccccgtaaccgttccccggttcccccgttcccccggttacggcccccgtcccgtacgtcccgtaacccgggaacggcccccg

SEQ ID NO: 387553 - DNA, 766 bp, Homo sapiens
  misc_feature: GZ8MTXP02GBJR0.22.86.H09.1.454.CMB.2.raw
  modified_base (232)..(232): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctagtggcatgcacgtggcctccgcaggccgtccgggngaaggggctgggaggtgggtggctaattatagtggtatgagtaggaaagtaaataaagacttagtggtacggactaccggtaggaacgggccgacttccacctactcctaccaagacgaaccaacctacaaacgaacctaccttcttaccgttttaccacctaaaagtacgtaaaccgacgaccgtagggacggaaggggaccggaacgggaaacccgacgggtacctaagggttagtttaaacgtttacgttacgggtacggacggtaaaggaagtacgttacggaaacctaggttacggaacgttaaacgggtaaagttcgttttacgagtccgttacgggtaccggggaacctaacggggactacgttacgggtacccctaccgtttctcgtttaaccggaccgttaccccgtaaccccgaacccgggtaaaccgggacccccgtttaaccggtccccggtttcccccgtccccccggttacgggccccgttacccccggttcgtaccccgtacccggaacgggtaccccg

SEQ ID NO: 387554 - DNA, 661 bp, Homo sapiens
  misc_feature: GZ8MTXP02FMBOE.22.86.H09.1.454.CMB.2.raw
  modified_base (353)..(353): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacggtccctgagactctcctgtgcagcgtctggattcaccttcagtggctagtggcatgcacgtggcctccggccgaggccgtccgggacgaagggggctggggaggtggggtgacctaattanagtggtatgaagtgggaaataaataaagactagtggtaggaaccgtccggtaggaaacgggccctaagtttaccaacccgtactcctaccgaagaacgaaacctaaacctaacccgaaacgaaacctaccttaccgtttacgtttaccctaaacctaaaacgttacggaaaaccacggtacccgtaggaaacggacggggaccggaacgggaaccgacggggacctaaaggttacgttaaagtttaccgtggtacggaacggaaacggtaagtacgtaccgtaaactaacggtacggtaaaacccggg

SEQ ID NO: 387555 - DNA, 600 bp, Homo sapiens
  misc_feature: GZ8MTXP02GKD3Y.22.86.H09.1.454.CMB.2.raw
  modified_base (320)..(320): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggtccaggcctggggaggtccctgagactctcctgtgcagcgtctggattcaccttcagtggcctatggcatgcactggctcccgccgaggcctcccggggnaaggggctggggaggtggggtgcctaattatagtggtatgaatggggaaattaaataaaaggacttaagtggtacgggacgtacccggtaggaaacggggtacccgtaattccaaccgtaactccttacccgaagaacgaaccaaacctaccgaaagaaacctaacttcttacggtttactacccaaaaatcggaaactcgactagaaggaggccggaggaacacgggactaggtagttactacgtggtacgaagagagtagccgaactacgtagaacgg

SEQ ID NO: 387556 - DNA, 587 bp, Homo sapiens
  misc_feature: GZ8MTXP02HIAR0.22.86.H09.1.454.CMB.2.raw
  modified_base (228)..(228): a, c, t, g, unknown or other
  modified_base (245)..(245): a, c, t, g, unknown or other
  modified_base (363)..(363): a, c, t, g, unknown or other
  modified_base (411)..(411): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggcctccgggnaaggggctggagtgggngacaattatatggtatgatggaaataataaagactatgtcggactccgtagaacggccgattcaccatctccgagacgacaactccaaagacactctcgtttaccaccaaatgaaacngcctggacgtaaggcgagaccagggctagtgtatacgtgtgcgagagntcgaacatacgaacgttaacggggaaattccgttttgaacttcgtacggtacggggacccgaaaggggtcaacgtcggggtccaccggttctccttcgacgtccctaccgaccgtaaacgggcccctagtcccggttccctccccgtggcccgtcccttgcccgtacgacggaccg

SEQ ID NO: 387557 - DNA, 628 bp, Homo sapiens
  misc_feature: GZ8MTXP02H8W7H.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactcctctgtgcagcgtctggattcgaccttcgagtggctagtggcatgcacgtggcctcccgcgacggccgtcccgggacgacggggcgtggggagtggggtgacctaatttgtagtggtaatggaattgggggtaaaattaaagtaaaaaggtactaagttgggtacgggtacctacccgggtaggaaccgggacccgtattaccgacctacgtctaccgaggaacaaacctaactacccgaaagaaacctaccttcgttacgtttactacccaaaatcgtaaacacgaccgttgaaggaggccggaacggacgacgggccgtaaggttacgttaagttacctaggttagaaccgtaggacgtatacggacaagtagtaaacccgg

SEQ ID NO: 387558 - DNA, 605 bp, Homo sapiens
  misc_feature: GZ8MTXP02JJO1V.22.86.H09.1.454.CMB.2.raw
  modified_base (363)..(363): a, c, t, g, unknown or other
  modified_base (400)..(400): a, c, t, g, unknown or other
  modified_base (421)..(421): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcgtccgggcaagggggctgggagtgggtggactaattatagtggtatggataggaaataaataaacgatagtggtggactcgtaggaggccgtaatcactatctcagagacaactcaagaacactctcgtttcctaccaaatanaacacgctgagaggcgagacgacgcagttgaattacnggtagacgagagactgaactntacgaacgtaacggggaaattactttgaacttcgaggtcgggtaacccaaggggacacgtaggtccctacgttctcgtaaccgtcacccgtaccccaaccggaacgggtccccctaaggttccccgttacccgttccccccggtggtccccgtccccgttacgcccgttacccgaggtaccccg

SEQ ID NO: 387559 - DNA, 797 bp, Homo sapiens
  misc_feature: GZ8MTXP02FOB6H.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggacggtccctgacgactctccgtgtgcagcgtctggattccaccttcaggtcggctagtggcatgcacgtcggcctcccggccgacgggccgtcccggggacgaacgggggtctaggggaggtggggtgacctaaattagtagttgggtatggtaagtagggaaagttaaaataaacggacttaagtcggtagggtaaccgttccgggtagggaaacggggtacccgtaacgtttacccgaacccgtacttacccgtaaccgaaacggaaacgaaaacccaaacccgttaaacccgaaaacgtaaaacctaacctttaccgttttaccgtttttaaccctaaacccgtaaaaacgttacgtaaaaccgacggtaccccgttaaaggggaacgggtaaccggggaccggggaaaaccggggtaaccggaaacccgggggaccgttaaaggtttaacgggtttaaaccgtttaaacccggttcggggttaacgggtaaccggtaaacgggaaacgggttaacgttaccgggtaaaaccgacggtttaaacggggttaaaaacccggg

SEQ ID NO: 387560 - DNA, 687 bp, Homo sapiens
  misc_feature: GZ8MTXP02H8J7P.22.86.H09.1.454.CMB.2.raw
  modified_base (192)..(192): a, c, t, g, unknown or other
  modified_base (196)..(196): a, c, t, g, unknown or other
tcagacatacgcgtcacgaccggtgctcgatttagtgctatagacttgggtttggggggaagaggaagactgacggtccctgccacaggtggtgctgggcacggtgggcactcgacacaacatttgcgctcaactgtcttgtctcaccatggagtttgggctgagctgggtttcctcgttgctcttttaagnggtntccagtgtcaggtgcagctgggtggagtcgtgggggagcgtggtccagcctgggagtccctgagctctcctgtgcagcgtctggattcaccttgagtcggctagtggctagtcgcacgtggcctccggccgaggccgtccggggacgaaggggctggggagtggggtagactaaagtttgtagtcgggtataggacgtagtaaagtaagtaaaagtctaagtggtacggtaccgttaccggaaggaaccggggtacctacgttaccgaaccgtaacttcccgaccaaagggaccctaaaccaaacgttaaccgaaaacgtaacctacccttacttacggtttaccctaaaccgaaaagttcgaaacccgaaggtcccgttaagggaggaaccgggaacggaaacgggtaacccgaacggggtacctaaaggttaccgttaagtttaaaccggtgggttaccggacggtaaacggtaagaacccgtaaccgg

SEQ ID NO: 387561 - DNA, 619 bp, Homo sapiens
  misc_feature: GZ8MTXP02ITFVL.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggaggtgggtgacaattatagtggtatgatggaaataataaagatatgtggactccggagaggcatcaccatctacagacgacaactaccaaagacactctctttacctaccaaatacgaacacgcctggagagggacggacggaccgacggctagttgtattacgtgaggcgaagagactacgacagtacgaacgttaaacggggtaaatttctttaggacttcgttcggtacgggggaccgaaggggtacacgttacggccgtaaccgttctaccgttacaccgtccctacccgaaccggtaaaccgggcccctacggttccccggttccccgttcccccggtcgggtccccgtccctcggtaccctccggaacggtacccg

SEQ ID NO: 387562 - DNA, 677 bp, Homo sapiens
  misc_feature: GZ8MTXP02HWL0I.22.86.H09.1.454.CMB.2.raw
  modified_base (226)..(226): a, c, t, g, unknown or other
  modified_base (240)..(240): a, c, t, g, unknown or other
  modified_base (350)..(350): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccggnagggctggagtggngactaattatatggtatgagtaggaaataataagatagtggtagactccgtaggaacgggcctattccgacctatcctaccaagacgaaccaactaccgaaaagtaaccnctttactcgtttacctaaccaaatacgaaccacgcctaggaaggtacggacgggtacgggaaccgtaacgggactaacgggttagttaacttacccggaggttcggaacggtaaagaacggttactacgggtaaacaaggttcggaaaaccgtaacgggggttaaactttccgttttaggtacttaccgtcggggttacgggaaccgtaacggggcttaacgggtgttaccctacgtcgtctacgccgcctacccgaagtacccgggcctacggtccttccccgtaaccccggtcgaccgtccccgtgacccgttcgaaccgggtcc

SEQ ID NO: 387563 - DNA, 684 bp, Homo sapiens
  misc_feature: GZ8MTXP02I3EJV.22.86.H09.1.454.CMB.2.raw
  modified_base (272)..(272): a, c, t, g, unknown or other
  modified_base (274)..(274): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagctggtggagtcgtgggggagcgtggtccagccgtgggagtcctgagctctcctgtncngcgtctggattccacttcgagtcggctagtggcatgacctacgtcgggcctcccggccgagggcccgtaccggggacaagggggctaggggaggtcggggtgaactaagttagtagttgggtatacggtaagtagggaaaagtaaataaagtactagtaggtacggtaccgtacgggtaaggaacggtccgtattacgacctacgtaccacgaaagacgaaacctaaaccgtccaaaagtaccctacctttacgttacctttaccaaacgtaaaacgtacgtaaaaccgtacgtacccgtaagggaaccgggaaagggaccccggaaaagggtaacccggaacggtaaccgtaaggttaagttaaccgtttggtacggtagggaccgaaacggggtataaaccgtaacgg

SEQ ID NO: 387564 - DNA, 802 bp, Homo sapiens
  misc_feature: GZ8MTXP02HYIOC.22.86.H09.1.454.CMB.2.raw
  modified_base (189)..(189): a, c, t, g, unknown or other
  modified_base (508)..(508): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttnagtggctatggcagtgcactggctccgcgaggcctaccgggagaagggggtctagggagggttgggtaggtactaaattatagtggtaagttgagtaagggaaagtaaataaaagtactaagtggtacggacgtcggtaggaagggtccgtattacaacctatcctacgaagacgaaacaaacctaccgaaaagaacctcttaccgtttaccgtttaccctaaaccgtaaaagtacgtaaacacggtacctagggaaggacggggaccggaaacggaaaccggtacgggtaccaagggttttacgaaacgttttaaggnggtacggaacggtaaagtagtaacgacggaaacgttagtaacgggtaaacgggttaaacggttaacgtttacgtttaacgtacgttacccgggtcgggtaaccggggtaaccggtaaagggtacccgttacggtacggttacccttaaccgtccttacgtaacccgccgtaaccccttaacccgaaaccgggtacccggttacccctaccgggtttcccccggttacccccgttcccccggtaccgggtcccccttaccccggtaccggtacccggttaacccggtacggcccg

SEQ ID NO: 387565 - DNA, 785 bp, Homo sapiens
  misc_feature: GZ8MTXP02J0G0X.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcacgtggcctccgccaggccgtccggggacgaagggggctgggaggtgggtgactaattatagtggtatggataggaaagtaaataaagtactaagtggtaggaccttccggtaggaacgggccgtattccaccatcctacagacgacaactacaaagaactctcttcgttaccacaaatgaacacgccgtggaacgacggacgaggaccgacggcagttagtaattacgtggtagacggtagagtacgtacggaactaggttacgtaaaccggttaaaccgggggtaaaagtttcgttttacggtaacttccgggttaccgggttacgggggaaacccgtaaacgggggtaaacccgtaccggttacgggttaccccgtaacccggtttccttacccgtttacccggaaaccggtcccccgtaaccccggaaacccccggtaaaccgggggttaccccccgttaaacccggttcccccgggtttaaccccccgtttcccccccgggttaccggggtacccccgttaccccccgggttcccggtacccccggttaaccccggaacccggggtaacccccgg

SEQ ID NO: 387566 - DNA, 729 bp, Homo sapiens
  misc_feature: GZ8MTXP02JGGKG.22.86.H09.1.454.CMB.2.raw
  modified_base (232)..(232): a, c, t, g, unknown or other
  modified_base (342)..(342): a, c, t, g, unknown or other
  modified_base (421)..(421): a, c, t, g, unknown or other
  modified_base (458)..(458): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgccagtcggcctccgccaggcgtccgggngaaggggctgggaggtgggtggactaattatagtggtatagagtaggaaataaacaaagctaagtgtacggaccgtaccggtaggaaacgggccgtaattccaacccgtnttaccgaccaagaacgaacctaaacctaccaaaagaaccttaccttcttacccgttttaccaacctaaagtacgaaacncgtccgtaggaacgaggggaccgaacggaccaacggnttaagttagtacgtttagagtacggaggaagacgtcgaaagtacgaagttacgtaaacggttaaacgggtaaactttggttttagacgttccgttaccggggtaacggggaaccgaaaggggtaccctaaggttcgggtaaccctaccggttcttaccttaccggaccctaccctacccggaaacccgtaccggtccccgtaccggttcccggtccccgtttcccccggcgggtacccctcccgtaccggtcctacccggaagtcccccgg

SEQ ID NO: 387567 - DNA, 814 bp, Homo sapiens
  misc_feature: GZ8MTXP02IA766.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggtccagccgtgggacggtccctgagctctcctgtgcagcgtctggattcaccttcagtggctagtggcagtgccacgtggccctcccggccgacgggtcccgtaccggggaccgaagggggccgtaggggtacggttcggggtcggaccctaaagtttagtaggttgggtaattggaagttacggggtaaaagtaaattaaaagtaccttaagtcgggtagggtacccgtcccgggttaagggaaacgggggtcccgtaacgtttacccaacccgttacgttacccgttacccgaaacggaaccgtaaaccctaaacgttaaaccccgaaaaggttaaacccctaacccgttttaccgtttaaccggttttacccgtaaaccctaaaagttaccggaaaacgtaccggtaccccgttaagggaaaccggggaacggggtaacccgggtaaacggggacccggttaaccggggaaccgttagggggtttaaaccttaaacgtttttaaccggggtacgggttaacggtaaccgggtaaacggtaacggtaaccgttaaccggaacccggttaaagggttaaccggtaaaacccgggg

SEQ ID NO: 387568 - DNA, 645 bp, Homo sapiens
  misc_feature: GZ8MTXP02FM073.22.86.H09.1.454.CMB.2.raw
  modified_base (590)..(590): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtcgtggattcaccttcagtggctagtggcatgcacgtggcctcccgcgacggccgtcccggggacgaagggggctaggggaggtggggtgacctaaagtttagtagtgggtaatggtaagtaggggaaaattaaattaaaaggacttaagtcggtaggtaccttccggtagggaaaccggggtcctaagttacccaacctactccctaccgaagaacgaaccaaacctacccgaaagtaacctaccttcgttacgttttacccaaaccgtaaacttacggaaaccacgtaccgtaggaacggacgggcggaaacggaccgtacggactaaggttnttaacgttacgtggtacgaagtaacgagtacgtccgaagtacgtacggtaaacgg

SEQ ID NO: 387569 - DNA, 694 bp, Homo sapiens
  misc_feature: GZ8MTXP02H7SEI.22.86.H09.1.454.CMB.2.raw
  modified_base (276)..(276): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcagctggtggagtcgtgggggagcgtggtccagccgtgggacggtccctgagactctcctgtgcagcgtctggattcaccttnagtgctatggcatgcacgtggcctccgccgaggcctccggggacgaaggggctagggacggtggggtgaacctaaagtttagtagtagggtatggaattaggggaaaagttaaaactaaagacttaagttggtacggtaccgtacccggtaggaaacgggggtaccctaagttcccaaacccgtatacccgttacccgaaaggaacccgaaccgtaaaacccttaacccgaaaacgtaaacccgtacctttacgtttaccggttttaacctaaccccgtaaaagttaaccgaaaacgacggttacccgaaggaaggaacggggtaaccgaacgggaaccgacgggtactaaaggttacggtaactttaacggttgaggaacggaagaagtacacggaactacgtacggtaaaaccggg

SEQ ID NO: 387570 - DNA, 679 bp, Homo sapiens
  misc_feature: GZ8MTXP02GIGM0.22.86.H09.1.454.CMB.2.raw
  modified_base (319)..(319): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtggggaggtcctgagactctcctgtgcagcgtctggacttcaccttcagtggctatggcatgcactggcctccgccgaggcgtccgggnggaaggggctagggaggtggggtagctaaagtttatagtaggtataggtaagtaggtaaaagttaaagtaaagggtacttaaaggttggtacgggtaaccgttaccggggtagggaaaacggggtcccgtaacgtttaccaaccgtaactaccttaccgaacggaacgaacctaaaccgtaccgaaaacgaaacccttactaccttaacgtttacctaactaaaacttacggaaaccgacgaccgtaggaacggaacggacgaacgggacgacgggtacgaggttagtaacgttacgtcgggtgtacggaaggaagtaacgtacgaacgtagtacgtaacggtaacgggtaaacgtttcg

SEQ ID NO: 387571 - DNA, 707 bp, Homo sapiens
  misc_feature: GZ8MTXP02IFPRO.22.86.H09.1.454.CMB.2.raw
  modified_base (341)..(341): a, c, t, g, unknown or other
  modified_base (370)..(370): a, c, t, g, unknown or other
  modified_base (457)..(457): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccacctttgagtggctagtggcagtgcacgtcgggcctcccggccgaggccgtaccggggagaggggctgggaggtgggtgactaagttatagtggtatgaagtaggaaataaataaagactagtgtacgactccggtaggaacggcgtataccactanctacgagacaaccaactacaaacgtaacnctcttaccgtttaccaaccaatacgaaactcgactggagagccggtagacgacggactaggtatttatacgtaggtcgacggaaagngtaacgtccgaatacggtaacggtaacggtaaacggtaaacgtttgtttaacgtacgttacggttacggggttaacggggaacggaaaacgggtaccgtacgtaccgggttaccctaccggttcgtttacctacccggccgtaacccccgttacgaaacccgggtaaaccggtcccccgtacgggtttcccctccccggtttaaccccgcccggttacccgtcccgtcgtaccccgtacgaacgggtccc

SEQ ID NO: 387572 - DNA, 754 bp, Homo sapiens
  misc_feature: GZ8MTXP02GJBCZ.22.86.H09.1.454.CMB.2.raw
  modified_base (503)..(503): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctagtggcatgcacgtggcctccgccaggccgtccgggcgaaggggctgggaggtgggtaggactaagttatagtaggtatgaataggaaagtaaactaaagactagtgtggtacgtccggtaggaacggccgtattaccaacctactacctaccgaacgaacgacctaaaccgttacccaaaacgtaacctacctttacgttaccgttttacccctaacccaaaagttaccgaaacgtaacgtaccgttagggaacgggtaacgggacggaacgggaccgaacgggctaagggttacgtaagtttaccgnggtacggacgaagtagactacgaacgagtacggtaaaccgttaaaggggtaaacgttcgttttacgaacgttccgtacggggtaccgggaaacccgtaagggaccctacggttaccgggtaccctacccggttctacccgttacgacccggtaccctacccggaaaccgaccgggtaccctaccggttcccggttacccctcccccggttggaccccctaccgttccggacccctacgaacggtaaccccg

SEQ ID NO: 387573 - DNA, 713 bp, Homo sapiens
  misc_feature: GZ8MTXP02I6LMC.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccagccgtgggacgtccctagacgactctccgtgtgcaggcgttctggacttccaccttcgaggtcggctagtggctatcgctacgtggcctcccggaccagggccgtcccggggagaacggggtctaggggaggtggggtacgacctaagtttacgtagtgggttaataggtagtacggggtaaaattaaaagtaaaaggtacgttagttcgggtacggtacccgttacggggtaggaaaccgggggtccctaaacggtttacccaacctaacgttcccgtaacgaaggtaacgaaacctaaacgttaacccgaaaacgtaacccttaactttaccgtttacgtttacctaaacccaaaagtacggtaaaccgacgtaacccgtagggaacgacggggacgtaaacgggacacgggtcgtaaaggttcgttactacgttcggacggaacggttagacggttacgaccgtaacgacgttacggtaaaccgg

SEQ ID NO: 387574 - DNA, 707 bp, Homo sapiens
  misc_feature: GZ8MTXP02JUWLN.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgccgaggccgtccggggacgaagggggctggggaggttgggtaggactaatttagtagtggtatgagtaggaaagtaaataaagactagtgtggacgtcggtaggaacggccgtattcacctactcgtcagacacaactacaaacgacacttacttcgtttaccaacctaaatacgaacacgcctaggagaacggacgaacggacgaccggtagtagttatagtttacgtgtacggagaaggatacgtacgaacgtagtacggtaaacggttaacgggtaaattcgttttagaccgttcgtaccggggtagggaacccgtaaaggtaccgtaaccgtcggttacccgttaccccggtcttaccgttaccgacccgttaccccttaaacccggaaccccgtaaccgggtacccccgtaacggtttcccccggttaccccgttcccccggtacggtccccgtccccgttacgccccgtacggaacggtccccg

SEQ ID NO: 387575 - DNA, 810 bp, Homo sapiens
  misc_feature: GZ8MTXP02I77KJ.22.86.H09.1.454.CMB.2.raw
tcagacatacgcgtcacgaccggtgctcgatttagtgctatagacttgggtttgggctgagctgggtttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccggccgaggccgtccgggacgaaggggcgtgggaggtgggtcgactaattagtagtggtatagagtaggaaattaaataaagaactagtggtacggtaccgtccggtaggaacgggtccgtacttacacctatcctacgaagaacgaaccaaactaccgaaacgacacctttctaccgttttacctaacctaaataccgaacgacgtccgtagggtacgacggggaccggaagggaaccgtacggggactaaaggggtttacgttaaacttttaaggttgggtacgggaacggtaaggaaacggtacgtaaccggtaaaccggtagttaaacccgggtaaaccggttaaaagggggttaaacccgtttagttttaggacccgtttcggttaccggggtaccgggggaaaccgaaacgggggtactaaccgggttcggtaacccgttccccgttcgttacccgttacccgacccgtacccgtaaaccccggaaaccggtacccggggtacccccttacggttccccccgggttccccctttcccccggcggtcccccggtcccgttaccgcccccggaaggttaaacccggccccg

SEQ ID NO: 387576 - DNA, 674 bp, Homo sapiens
  misc_feature: GZ8MTXP02JF4N6.22.86.H09.1.454.CMB.2.raw
  modified_base (469)..(469): a, c, t, g, unknown or other
  modified_base (483)..(483): a, c, t, g, unknown or other
  modified_base (519)..(519): a, c, t, g, unknown or other
  modified_base (523)..(523): a, c, t, g, unknown or other
  modified_base (531)..(531): a, c, t, g, unknown or other
  modified_base (594)..(594): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattccaccttcagtggctatggcatgcacgtcggcctccgccgaggtccgtccgggacgaaggggcgtgggaggtgggtgactaattagtagttaggtataggtagtaggtaaagtaaactaacgtatagtaggtcggtacgtaccggtaggaacggtccgtaacttaccaactactctaccgaaggaaccaaacctaacctaaccaaacgtaacctaccgtttacttaccgtttaacccaacctaaagtacgaaccagtaccgtaggacgacggacggaacgtacgacggntagttagtattcgngtcgagtaagatcgacaagtgacgaacgtaaaggtntttntttaacgngttaccgtcggggaacggaacccgaggtacctacggtcgttacccgtacgttctcggtaaccnccgtcccctaaccggaacgaccggtcctccggttcccgtcccctccgggaattccccgcgtacgccgtaccgagtacccc

SEQ ID NO: 387577 - DNA, 593 bp, Homo sapiens
  misc_feature: GZ8MTXP02FUNUW.22.86.H09.1.454.CMB.2.raw
  modified_base (254)..(254): a, c, t, g, unknown or other
  modified_base (451)..(451): a, c, t, g, unknown or other
  modified_base (529)..(529): a, c, t, g, unknown or other
  modified_base (535)..(535): a, c, t, g, unknown or other
  modified_base (572)..(572): a, c, t, g, unknown or other
  modified_base (577)..(577): a, c, t, g, unknown or other
  modified_base (585)..(585): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgccaggctccgggcaaggggctggagtgggtggcaattanagtggtatgataggaaataaataaagatatgtggactcgtaggaacggctatcacatctaccaagacgacaactaccaaagaactacttctcgtttacctaccaaaatacgaacgacgacctggaagacggggacgagggaaccgaacgggtcaagttagttaattacgtgtacggacggaagtaagacgtacgaanaagtacgtaacgtaaacggggaaatttctttagacgttcgtcgggtaggggacctaaaggggctacgtgtacaccgtntctacncgcctaccgacgaacggccctagtcccgtcctcccgnggccnccctgccncgacgacc

SEQ ID NO: 387578 - DNA, 687 bp, Homo sapiens
  misc_feature: GZ8MTXP02ISWPI.22.86.H09.1.454.CMB.2.raw
  modified_base (93)..(93): a, c, t, g, unknown or other
  modified_base (254)..(254): a, c, t, g, unknown or other
  modified_base (370)..(370): a, c, t, g, unknown or other
tcagacatacgcgtcacgaccggtgctcgatttagtgctatagacttgggtttgggctgagctgggttttcctcgttgctcttttaagaggtntccagtgtcaggtgcagctggtggagtcgtgggggaggcgtggtccagcctggggaggtccctgagactctcctgtgcagcgtctggattccaccttcagtggctatggcatgcactggctccgcaggctccgggcaggggctggagtgggtgactaattntatggtatgatggaaagtaataagactagtgtggactccggagaaggcgtattcacctatctacagagactaactaccaaagaaccactcttacgtttaccactaaaatcgaaacncgcctggacgaggacggacgacgacggctaggtagtattacgtgtagacgtaaggagacgttacgaacgtaagtacggaaacggtaacggggtaaaacgtttcggttttacgacgtttccgtaccggggtacgggggtaccgtaaacgggggtaactacgggtacggttaccgtaacccggtttacttccgtttaccgaccgtaccccgttacccgaaacccggtaaaccgggtccccgtaaccggttccccggtttaccccgttcccccggtcgggtccccgtccccggtcggtcccttaccggaacggtacccgg

SEQ ID NO: 387579 - DNA, 497 bp, Homo sapiens
  misc_feature: GZ8MTXP02GWB7B.22.86.H09.1.454.CMB.2.raw
  modified_base (309)..(309): a, c, t, g, unknown or other
  modified_base (325)..(325): a, c, t, g, unknown or other
  modified_base (352)..(352): a, c, t, g, unknown or other
  modified_base (364)..(364): a, c, t, g, unknown or other
  modified_base (388)..(388): a, c, t, g, unknown or other
  modified_base (393)..(393): a, c, t, g, unknown or other
  modified_base (463)..(463): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagctctcctgtgcagcgtctggattcaccttcagtggctatggcatgcactggctccgcaggctccgggnaggggctggagtgggngctatatatgtatgatgggaaataaanaaagactagtgngactcgtagacgggcatcacatcncaganacactacaagactactctgttctaccaaatcaacagctagaagagcgagacgaggcagtagtacttacgnggtagcggagacgacgtacgacagtacgtaacgg

SEQ ID NO: 387580 - DNA, 675 bp, Homo sapiens
  misc_feature: GZ8MTXP02JTD6B.22.86.H09.1.454.CMB.2.raw
  modified_base (599)..(599): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccgaggccgtccgggcgaagggggctgggaggtggggtgactaattatagtggtataggataggaaagtaaataaagactagtggtacggacgtccggtagggaacgggccgtaattccaacctatccgtaccgaaggaacgaacctaaacctacccaaaacgtaacctaaccttcttaccgtttacctaaccctaaaatacgaaacacgcctaggaggacgggacggacggacgacgggacaaggttgttaagttacgtaggtacggcggaaaggacgtaacgtacggaactaagtaggtaaaccgtaaaacgggggtaatttaccggttttagacgttcgtcgggtacgggaccgaaaggtcgtacgtcgtacctaccgtntcctacgactcctaccgaccgacgtcctacgtcccgtcccgtccccgcggcctcctacggtcctacgacggtaccc

SEQ ID NO: 387581 - DNA, 508 bp, Homo sapiens
  misc_feature: GZ8MTXP02G62TN.22.86.H09.1.454.CMB.2.raw
  modified_base (335)..(335): a, c, t, g, unknown or other
  modified_base (356)..(356): a, c, t, g, unknown or other
  modified_base (439)..(439): a, c, t, g, unknown or other
  modified_base (465)..(465): a, c, t, g, unknown or other
  modified_base (477)..(477): a, c, t, g, unknown or other
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctccgcaggcctccgggcaaggggctgggagtgggtgcaattnagtggtatggatggaaataanaagctagtgtgacctcggagaacgggcattcacatcacagacacaactcaagacactctgtttcacaatgaactgcctagagngcgagacacggcagtgtacttacggngacgacgagagngtacgacacgtagaacgtaacggtaacttcg

SEQ ID NO: 387582 - DNA, 697 bp, Homo sapiens
  misc_feature: GZ8MTXP02JKPA7.22.86.H09.1.454.CMB.2.raw
  modified_base (193)..(193): a, c, t, g, unknown or other
  modified_base (413)..(413): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagnggtgtccagtgtcaggtgcagctgggtggagtcgtgggggagcggtggtccagccgtggggagtccctggacgacttcctcgtgtgcgagcgttctaggcttccacgttcaggtcggctaagtgggacagtcgactacgtggaccctcccggaccgaggtccgtaccggggacgtaaaggggtcctcggggtaagggtggggtacgtaactaaaagtttnttaagggtggttatacggtaagtacggtaaaagtaacgtaaagtacgtagtcggtaggtaaccgtcgggtaggaacccggtccgtaattccgaaaccgtagtccgtaccgaaagggacctaaacctaaccgtacgaaaacgtacccgttaacttccgttagtttacctaacgaaaagtcgaaaaccgtggacccgtagaacgggtcggaaacgggacgtaaccgggacgggtctaagggttacgtaaagttccgggtgtacgagtaccgaagtacgtaaccggg

SEQ ID NO: 387583 - DNA, 592 bp, Homo sapiens
  misc_feature: GZ8MTXP02IEDRA.22.86.H09.1.454.CMB.2.raw
  modified_base (255)..(255): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggcctccgggcaaggggctggagtgggtggctaaattntatggtatgataggaaagtaataaagactatgtggactccgtagaaggccgatcacatctcagagacaactccaaagaacactctcgtttacctaccaaaatcgaacagcctgagaggcgagacacggcagtagtatactgtgcgagagatcgaacagtgaacgtaaacgggaaagtcgtttttagagttcgttacggtacgggggtaaccgaaggggaactacgttcggtacctaccggtctaccttcgaccggtaccctccgaacccgtaacgggacccctacgtcccgttcccttcccccgtcgccctccccgtagcccgtaccgaggtacccg

SEQ ID NO: 387584 - DNA, 558 bp, Homo sapiens
  misc_feature: GZ8MTXP02JL2HB.22.86.H09.1.454.CMB.2.raw
  modified_base (216)..(216): a, c, t, g, unknown or other
  modified_base (230)..(230): a, c, t, g, unknown or other
  modified_base (296)..(296): a, c, t, g, unknown or other
  modified_base (299)..(299): a, c, t, g, unknown or other
  modified_base (314)..(314): a, c, t, g, unknown or other
  modified_base (317)..(317): a, c, t, g, unknown or other
  modified_base (335)..(335): a, c, t, g, unknown or other
  modified_base (374)..(374): a, c, t, g, unknown or other
  modified_base (407)..(407): a, c, t, g, unknown or other
  modified_base (536)..(536): a, c, t, g, unknown or other
tcagacatacgcgtcacgaccggtgctcgatttagtgctatagacttgggtttggggggggtctcaggaggcagcactctcaggacgtcaccaccatggcctgggctctgctattcctcaccttcctcactcagggcacagggtcctgggcccagtctgccctgacccagcctgcctccgtgtctggatcatctggacagtcgatcagcatttccngcactgggaccaangtgacattgggtctttgactctgtctctgtaccaacacaccagccaaacccccatcatcatttacngtntcactcgtcgccctnagngtctctctatccgcttcncagctccaagtctaggcacgtcgcctacctaccatcctntcggctcagtttgagtacgagtctattattacngtctaacgttctttaaagtggtcctccaacttccgtcggtttgggtttccggacggtacggtaccacggtaacgttcgacccgtcgtccggttacacgtcccaacggctccggcccccttcggttcccnccgttcctccgttccccacccg

SEQ ID NO: 387585 - DNA, 640 bp, Homo sapiens
  misc_feature: GZ8MTXP02JIP9O.22.86.H09.1.454.CMB.2.raw
  modified_base (227)..(227): a, c, t, g, unknown or other
  modified_base (368)..(368): a, c, t, g, unknown or other
  modified_base (398)..(398): a, c, t, g, unknown or other
  modified_base (416)..(416): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtgactaattatatggtatgagtaggaaagtaaataaagactagtgtggactccggtaggaaggcgtattcaccatctcagacacaactaccaagacacttctcgttcacaaatacgaacacgcngagaggcgacgacacggcagtgtattacgngtgacgagagactacganaagtacgaacgttaaacgggtaaagttcgttttagacttccgtcgggtacggggaacccgtaaggggacctacggtccggttacccgtaccgttccgttccttaccgaccgtacccccgtaaccccggaaacccgtaaacccggggtcccctaacggttcccccggttccccttaacccccggtcggtccccgtccccgtcgtcccgtacccggacggtacccg

SEQ ID NO: 387586 - DNA, 715 bp, Homo sapiens
  misc_feature: GZ8MTXP02IBJPH.22.86.H09.1.454.CMB.2.raw
  modified_base (263)..(263): a, c, t, g, unknown or other
  modified_base (271)..(271): a, c, t, g, unknown or other
  modified_base (279)..(279): a, c, t, g, unknown or other
  modified_base (523)..(523): a, c, t, g, unknown or other
  modified_base (573)..(573): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggagtccctgagctctctgtgcagcgtctggnttcacttnagtgctangcagtgcacgtggcctccgccgaggtccgtaccggggacgaagggggcctaggggtacggtggggtacggactaaagtttagtaggttacggggtatagggaacgttaggggtaaaaagttaaaacgtaagggtccttaaaggtcgggttacggacccgttccggtagggtaaaccggggaccctattacccgaaacctagttcccgtacccgaaagtaacgaacctaaacccgtaccgaaaanaacccttacctttcgttaccgtttaaccaacccaaaattccggaaaaccnccgtacgtaggaaggaacggacggaaacgacggaaccggtactaagggtttacgttaacttaccgggtaggtacgaacggtaagacgtaacgtaaccggaaacgtacggtaacggtaaccggtttaaaacgggtaactttcg

SEQ ID NO: 387587 - DNA, 577 bp, Homo sapiens
  misc_feature: GZ8MTXP02F7DB3.22.86.H09.1.454.CMB.2.raw
  modified_base (307)..(307): a, c, t, g, unknown or other
  modified_base (338)..(338): a, c, t, g, unknown or other
  modified_base (354)..(354): a, c, t, g, unknown or other
tcagacatacgcgtcacgaccggtgctcgatttagtgctatagacttgggtttggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcacctatcctcctacactggaaccagcagtgattggttggtgttaataactatgtctcgtagtacaacaacaccagacaacaccccaatcatgtatttangacgtacactaacgccgcctacggcggtccngtactccgtacttccncgacgctacgaatcgtcgacaccgaccgcctaccactatctcgtgctcgtagttgacgactatcgtattactacttacgtctaacgtttacgtttaaagtcgaccgtacctacgttcgtcggtttcgggtttaggcggtacgtacgacgtaacgtccgtacgtcctcggctacgccgtaacgcgtcccgccccggttgccctacgttcctcccgtccctcccg

SEQ ID NO: 387588 - DNA, 747 bp, Homo sapiens
  misc_feature: GZ8MTXP02I6STD.22.86.H09.1.454.CMB.2.raw
  modified_base (233)..(233): a, c, t, g, unknown or other
  modified_base (457)..(457): a, c, t, g, unknown or other
  modified_base (475)..(475): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggagcgtggtccagcctgggaggtccctgagactctcctgtgcagcgtctggattcacttcagtggctatggcatgcactggcctccgccgaggccgtccgggganaacggggctgggaggtgggtgactaattagtagtggtataggataggaaataaataagactatgtggtactaccggtggaacggccgtattcgaccatcctacagaagacaaccgtaccaaagtaaccacttcctcgttttacccaccgtaaaatcgaacctaacggccctagggacggacggggaccgaaagggtccgaacggcgagttaggtatttaaccgngtaggacggagaaacgtntaccgaataagtaccgaacggttaaacgggaaaacgtttcgttttaacggtcgttacccggttacgggggtaccgggggaaccgtaaacgggggtaccctaaccgggtttacggtacccgttaacccggtttcccttaccgttacccgacccgttacccccgtacccccgaaaaccgggtaccccgggtacccttaacccggttccccggttacccccgtttcccccgcgggtacccccgtcccgttcgacccgttcccggaacggaccccg

SEQ ID NO: 387589 - DNA, 642 bp, Homo sapiens
  misc_feature: GZ8MTXP02ITO0V.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacgtccctgacgctctcctgtgcagcgtctggattcacttcagtggctatggcatgcacgtggcctcccgccgaggccgtccggggcgaaggggctgggaggtggggtgacctaagttatagtggtatggatggggaaattaaactaaagacttagtggtacgggtactcgggtagaacgggtccgaagttccaacctatcccgtaccaacgaacgaaaccaaccgttaaccaaaacgtaaacctaaccttacgtttaccgtttacctaacccctaaaagttaccggaaactacgacccgttaggaacggtacgggaccggaacgggaccgaacgggcctaaaggttagttaacgtttaacgtggttacggaacggaagtaagacgttacggaactagtacggtaaacggg

SEQ ID NO: 387590 - DNA, 580 bp, Homo sapiens
  misc_feature: GZ8MTXP02JHRX4.22.86.H09.1.454.CMB.2.raw
  modified_base (174)..(174): a, c, t, g, unknown or other
  modified_base (337)..(337): a, c, t, g, unknown or other
  modified_base (356)..(356): a, c, t, g, unknown or other
  modified_base (364)..(364): a, c, t, g, unknown or other
tcagacatacgcgtcacgaccggtgctcgatttagtgctatagacttgggtttgggggaagaggaagactgacggtcctgccacaggtggtgctgggcacggtgggcactcgacacaacatttgcgctcaactgtcttgtctcaccatggagtttgggctgagctgggtttccncgttagctcttttaagaggtgtccagtgtcagtgcagctggtggagtctgggggagcgtggtccagcctgggaggtccctgacgactctcctgtgcagcgtctggattcaccttcagttggctatgggcatcgcacgttgcctccgaccaggctacccggggngacggggctgggagtgggnctaatcgngttgtactagagtacggaattaaactaaagtactatcgtcgtaacgtcgtaggaacgggccgtataccgacgtatccgtaccgagacgaaccaacgtacaaacgactacctcgttacgttacaaccagtacgaacgacgacgtacgacgacggacggacggacgacggtacgtacgttacgttaacgtacgtacgtacgtacgacgacgacgtacg

SEQ ID NO: 387591 - DNA, 676 bp, Homo sapiens
  misc_feature: GZ8MTXP02FTZVZ.22.86.H09.1.454.CMB.2.raw
  modified_base (477)..(477): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggcctccgccaggcctcgggcaaggggctgggagtgggtgactaattatagtggtatgagtaggaaagtaataaagactagtgaggtacctcggtaggaaacgggccgtaattccaacctatcctacaagacgaaccaaccgtaccaaagtaacctacttccttacgtttacccaaccaaaagtcgaaaccgtacggccgtggaaaggacggggacgaacgggtacgaaccgggtataggttagttagttaacgtgacggagaaggacngtacgacatacggaacgtaaacgggtaatcgtttagcgttacgccgggtagggacccgaaaggggtacctacgggttcgtacccgtaaccgttcttaccgtacgaccggtacccctaaccgaccgtaaaccgggtcccctacggtccccggtccccttcccccggcggtccctacccggtgtcccaccggaaggtcccc

SEQ ID NO: 387592 - DNA, 762 bp, Homo sapiens
  misc_feature: GZ8MTXP02JIAJV.22.86.H09.1.454.CMB.2.raw
  modified_base (175)..(175): a, c, t, g, unknown or other
  modified_base (252)..(252): a, c, t, g, unknown or other
  modified_base (263)..(263): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgcttcttttaagnggtgtccagtgtcaggtgcagcgtggtggagtcgtgggggagcgtggtccagccgtgggacgtcctgagctctctgngcagctctggnttcactcgagtgctatggctagtgcctacgtcggcctcccgacgacggccgtccggggacggaagggtccggtggggacgggttggggtacggacttaaagtttagtaggttaggtaagtggtaagttaaggtaaaagttaaataacggtacctttaaggtgggttaccggtaacgttcccgggaaagggaacggggtaccttacgttaccaacccgtatcccgttaacgaaactacggaaaccaaacctaaccgaaaactaacctaccgttacctttacgtttaacctaacccgaaaagttacggaaaacccacggttaccgtaacggggaaaggaccggacgggtaaacggaacgtacggggtaaccgttacgggttagttaaaacggtttccgacgggttacgggaaaacggtaaggtacgaaccggtccgggtaaaacctaacggggttaaacggtaaaaccccggtttaaaacggggaaacgttttttcccggg

SEQ ID NO: 387593 - DNA, 771 bp, Homo sapiens
  misc_feature: GZ8MTXP02GH3OB.22.86.H09.1.454.CMB.2.raw
  modified_base (341)..(341): a, c, t, g, unknown or other
  modified_base (400)..(400): a, c, t, g, unknown or other
  modified_base (464)..(464): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctagtggcagtgcacgtcggcctcccggccagggccgtcccggggacgaagggggtctagggaggtgggtagactaattatagtggtatgaataggaaataaataagtactagtgaggtactccggaggaacggcgtactccgaaccntcctaccagacgaacctaacctaccaaagaacacttctaccgtttaccaaccaaagtanaaacttcgactcgggaaagacgggacgaacgtaccgaacggtcgtaagtagttaaatttaccgngtaacgagaaagagtaacgtccgaatagtacgtaacgtaaacggggtaagttcgttttaacgattaccggcgggttacggggaaacccccgtaaaggggaccttaaaccggtcggtacccgtaaccccgggttctttcccgggtttaaaacccgtcccggtaaacccctaaccccgggtaaacccgggtaaccccggtaccccgtttaaccccggttcccccggtttaccccccggttaacccccggttacccgggtacccccgtaccccggtaccgttaaccccggtaccggaaccgggtaacccg

SEQ ID NO: 387594 - DNA, 681 bp, Homo sapiens
  misc_feature: GZ8MTXP02JEMWD.22.86.H09.1.454.CMB.2.raw
  modified_base (231)..(231): a, c, t, g, unknown or other
  modified_base (257)..(257): a, c, t, g, unknown or other
  modified_base (265)..(265): a, c, t, g, unknown or other
  modified_base (279)..(279): a, c, t, g, unknown or other
  modified_base (427)..(427): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattccaccttcgagtggctagtggcatgcactggcctccgcaggcgtccgggnaggggctgggagtgggtgctaagttnagtggtangataggaaagtaanaaagatatggtacggactcggtaggaacggccgtatacgacctactccgtacagaacgaactaacctacgaaacgaactaccttacgttaccgtttaccaaccgtaaaatacgaacgacgtacctagggagagggaccgagacacggntaggtatatacgtgtagacgagagactacgacgtaagtacgaacgtaacggtaaagttcgtttagcttaccggttcgggaacggacccgaaagggtacctacggtacgtaccccgtaacgttcctaccgttaccgaccggtttaccccaaccccggtaaaccggaaaccggtccccgtaaccgttcccgtaccccccggtttccccggacggtcccccgtacccgtcgtacccgtaacccggacggtaaccccg

SEQ ID NO: 387595 - DNA, 640 bp, Homo sapiens
  misc_feature: GZ8MTXP02IZ015.22.86.H09.1.454.CMB.2.raw
  modified_base (312)..(312): a, c, t, g, unknown or other
  modified_base (605)..(605): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgacgactctctgtgcagcgtctggattcacttcagtgactatggcatgcactggcctccgcacggcgtcccgggngaaggggctgggaggtggggtcgcctaagttatagtgggtactggaagtacgggaaagttaaataaaaggactaagtggttacggaccgtacccggtaggaaacgggggtccctaaagttacccaaccctatacccgtaacgaggtaaacaaacaaccgtaaccaaagtaaaccctacgttacttacgtttacctaaccctaaaatacgaaacttacgaccgttaggaaacgggtacggacggaaaacggcgtaacggaccgtgttaagttaccgttaaccgttgaaaccggnggaacgacggtactacgaactaagtacgtaaacgg

SEQ ID NO: 387596 - DNA, 643 bp, Homo sapiens
  misc_feature: GZ8MTXP02IFBB4.22.86.H09.1.454.CMB.2.raw
  modified_base (432)..(432): a, c, t, g, unknown or other
  modified_base (580)..(580): a, c, t, g, unknown or other
tcagacatacgcgtcacgaccggtgctcgatttagtgctatagacttgagctctgggagaggagcccagcactagaagtcggcggtgtttccattcggtgatcagcactgaacactagaggactcaccatggagtttgggctgagtctgggttttcctcgttgctcttttaagaggtgtccagtgtcaggtgcaggctgggtggaggtcggtgggggaggcgtggtccagccgtgggacggtccctgacgtactctcctgtgcagcgtcgtggtacttcaccttcgagtcggctagtcggctatgcctacgtcggccgtccgcgacgggtccgtcccggggacgaaggggctggggtacggtggggtagacctaagttagtagtagggtacttggaagttaggggtaaaacttaaagtaaaacgtcttaggnggtacggtaccgtaccgggtagaaacgggtccgtataccgactactccctagaacgacgaaccaactaccgaaactaactctttcgtactttacaaccgaaatcgaaactcgtaccgagaaagggtcggacggaacggaccgacgggnttacgggtacttaagtccgttagaggaacgtaagacgagtacgaacgtgtaaacggtaaccgg

SEQ ID NO: 387597 - DNA, 655 bp, Homo sapiens
  misc_feature: GZ8MTXP02HZJSM.22.86.H09.1.454.CMB.2.raw
  modified_base (189)..(189): a, c, t, g, unknown or other
  modified_base (261)..(261): a, c, t, g, unknown or other
  modified_base (444)..(444): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattccaccttnagtggctatggcatgcagtgcctccgccaggctccgggagaaggggctgggaggtgggtagactaaagtttntagtggtatgagtaggaaataaataaagtactagtgtcggacctcggtaggaacgggtcctataccaacctatcctaccgagaacgaacctaacgacaaaacgtactactacttccgtttacaaccaaaagtcgaaaactcgctggaagacggacgaaggactacggatagtatatacgtagngagagtagatcgaaatagagaaacgtaacgggtaacttgtttacgagttccgtacgggtacgggacgtaaacggcctaacgtcggtacctaccgttctccgttaccgaaccttcccgaaaccctaaacccggaacggtccctaaccgttcccggttcccctaaccccggtcggcccctaacccgtcgaccccgtacggtaaccggtacccg

SEQ ID NO: 387598 - DNA, 639 bp, Homo sapiens
  misc_feature: GZ8MTXP02JNGX4.22.86.H09.1.454.CMB.2.raw
  modified_base (274)..(274): a, c, t, g, unknown or other
  modified_base (319)..(319): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctccgtgtgcagcgtctggattcaccttnagtggctagtggcatgcactggcctccgccaggcctcccgggganaaggggctgggaggtggggtgacctaagttatagtggtatggaataggggaaattaaataaaacgataagtggtaggacctccggtagaaacggggccattccaacctatcctaccgaagacgaaccaaactaccaaacgaaacctaccttacttacgttttacccaaccctaaaagttcgaaaacccgtacggtaccgtagggaagggacgggacggtaaacggaaccggtaccgggacgttaagggttacgtttaacgttacggtggtacggaacgtaaaggaacggttacgaaccgaacgtacgtaacggtaaacgg

SEQ ID NO: 387599 - DNA, 722 bp, Homo sapiens
  misc_feature: GZ8MTXP02HN2IS.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggacaattatagtggtatgataggaaagtaaataaagactagtgtggactccgtgaacggcatcaccatctaccagacgacaactaccaaagaacactctacgtttactaccaaatagaacacgcctggaacggaggacgacgacgacggactagtgttaatacgtgtcgagtagagtatacgactagtacgaacgtaaaccggggaaatttcgttttacgtaattccggttacgggtacgggggtaaccccgaaagggggtaccctacgttaccgggtacccgtaacccgtttccttacccgtttacgaaccccggtccccgtttaaccccgaaaacccgggaacccgggggtaccccccttaacggggtttccccccggggtttacccccttcccccccgggtttaaccggggcccccgttaccccccggtttacggggcccccttacccccgggggtaaacggaacccccccgg

SEQ ID NO: 387600 - DNA, 721 bp, Homo sapiens
  misc_feature: GZ8MTXP02F3QWW.22.86.H09.1.454.CMB.2.raw
  modified_base (172)..(172): a, c, t, g, unknown or other
  modified_base (351)..(351): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagcgtggtggagtcgtgggggaggcgtggtccaggccgtgggacgtccctgacgctcgtcctgtgcaggtcgtacgtggtacttccacctttgaggttcggctaagtgggacctagtcgcgtacgtcggtcctccccggcgacgggtccgtacccggggngtaacgggggtctaggggaggttcggggtagaccctaaatttagtagtagggttatgtaacgttagggggaaaattaaagtaaaacgtctaagtttgggtaaggtacccgttacgggtacggtaaaccggggtcccgttaagtttacccgaaccgtactcccgtaaccgaagacgtaaacccaaacttaaccgaaaacgtaacctactttacttacccgttttaacgacccttaaaacgtacgaaaccgtacgacccggttaaggaacgggtacggggacggaaacgggacgaacccggggataacggttagttaccgttaacgtgtacggaacggagtaaacgacgtacgactaacgtcgtaaacgggg

SEQ ID NO: 387601 - DNA, 576 bp, Homo sapiens
  misc_feature: GZ8MTXP02GVC6H.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgcttcttttaagaggtgtccagtgtcaggtgcagctggtggagtcgtgggggagcgtggtccagccgtgggacgtccctgagtactctccctgtgcagcgtctggattcaccttcagtggctatggcatgcacgtgctccgccaggccgtccgggcaaggggctggggagtgggtgacgtaattagtatgggtatgagtaggaaagtaaactaaagatagtgtagacgtcgtaggaagggacgacgttacactactctaccagacgtaacaactaccaagaactacctcttacgttactacctaaagtacgaacacgaccgtagacggacggacgacggaacgacggaccgtagttacggtaattaacgtggtagacgacggtaagacgtaacgg

SEQ ID NO: 387602 - DNA, 771 bp, Homo sapiens
  misc_feature: GZ8MTXP02JLTYP.22.86.H09.1.454.CMB.2.raw
  modified_base (196)..(196): a, c, t, g, unknown or other
  modified_base (744)..(744): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcgttgggttttcctcgttgcttcgttttaagnggtgtccagtgtcaggtgcagcgtgggtggagtcgtgggggagcgtggtccagccgtgggcgtcctgacgctctcctggtcgcaggtcgtcgtaggtacttacctacccgtttcgaggttcggacctttaagtcgggacctaagtcggaccctaacggttcgggtccccgtcccccgggaccggtaacgggtcccgggttaaccccggggacggtaaaacggggggtccgtagggggtacgggttggggttaacggtacgttaaagtttaagttagggttacggggttaattacgggtaaagttaaggggtaaaagttaaaaacgtaaaacgggtagttaaagtcggtaacggtaaccgtccggtaaggaaaccggggtacctacgttccaaccgtaacgcttaaccgaagtaaccgaaaccctaacaaccgtaaaagaacccttacgttacgttaccgtttaccacgtaaaactacggaaacctacggacctagggaacggacggaccggaacgaaccggacgacgtaaacgttgtaacgttaacgngggtagaccgaaggacgtactaaccgg

SEQ ID NO: 387603 - DNA, 644 bp, Homo sapiens
  misc_feature: GZ8MTXP02JUCQO.22.86.H09.1.454.CMB.2.raw
  modified_base (286)..(286): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcaccttcagtgctatggcagtncactggcctccgcgagggcctcccggggcaaggggcttggggaggtgggggtgacctaatttagatgggtataggatggggaaaataaagtaaagacgttagtcgggttacggaccgttaccgggtaggtaaacgggggcccgtacgtttacccaacccgtattcccgtaccgaacgaacgaaccgaaaccttaacccgaaaacggtaaacctaccttacgttacggtttacccttaacctaaaacgttaacgaaaccgaacggtccctaggaacggacggacggaaacggaccggaccggacgaggtagttaccgttacgtaggtagccgtaagacgactacgtacagtacgaacgg

SEQ ID NO: 387604 - DNA, 515 bp, Homo sapiens
  misc_feature: GZ8MTXP02JER0R.22.86.H09.1.454.CMB.2.raw
  modified_base (214)..(214): a, c, t, g, unknown or other
  modified_base (260)..(260): a, c, t, g, unknown or other
  modified_base (274)..(274): a, c, t, g, unknown or other
  modified_base (279)..(279): a, c, t, g, unknown or other
  modified_base (282)..(282): a, c, t, g, unknown or other
  modified_base (284)..(284): a, c, t, g, unknown or other
  modified_base (289)..(289): a, c, t, g, unknown or other
  modified_base (291)..(291): a, c, t, g, unknown or other
  modified_base (293)..(293): a, c, t, g, unknown or other
  modified_base (296)..(296): a, c, t, g, unknown or other
  modified_base (298)..(298): a, c, t, g, unknown or other
  modified_base (301)..(301): a, c, t, g, unknown or other
  modified_base (318)..(318): a, c, t, g, unknown or other
  modified_base (322)..(322): a, c, t, g, unknown or other
  modified_base (326)..(326): a, c, t, g, unknown or other
tcagacatacgcgtcacgaccggtgctcgatttagtgctatagacttgggtttgggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagcnggtggagtctggggagcgtggtccagcctgggagtccctgagctcncctgtcgcagcgtngatcnctngngctgngnangcncngcncgcgcgcgccgcgaggngcgngtgngcatatagtgtagtagagtagaagtaagtaagatagtagtgtacgtacgtgacgacgtactacacactcacgagacgacactacgaacgaacactactcgttacgtactaactacgtacgtacgacgtacgagaggacgacgacgacgacgagtcgtaagtacgtacgtacgacgacgacgtacgtacg

SEQ ID NO: 387605 - DNA, 508 bp, Homo sapiens
  misc_feature: GZ8MTXP02I9ZPU.22.86.H09.1.454.CMB.2.raw
  modified_base (359)..(359): a, c, t, g, unknown or other
  modified_base (426)..(426): a, c, t, g, unknown or other
  modified_base (428)..(428): a, c, t, g, unknown or other
  modified_base (437)..(437): a, c, t, g, unknown or other
  modified_base (442)..(442): a, c, t, g, unknown or other
  modified_base (444)..(444): a, c, t, g, unknown or other
  modified_base (452)..(453): a, c, t, g, unknown or other
  modified_base (455)..(455): a, c, t, g, unknown or other
  modified_base (459)..(459): a, c, t, g, unknown or other
  modified_base (505)..(505): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcatggctccgcaggctccgggcaaaggggctgggagtggggtggacaattanatgggtatggataggaaagtaaataaaagctaatgtgactcgtgaaggtcgatcaccatcgtcagananaactcaaanacatntntacacaannanagcngagagacgagacgacgacgagtagtaagtacgtagtgagacgaganacg

SEQ ID NO: 387606 - DNA, 724 bp, Homo sapiens
  misc_feature: GZ8MTXP02IRUOR.22.86.H09.1.454.CMB.2.raw
  modified_base (231)..(231): a, c, t, g, unknown or other
  modified_base (254)..(254): a, c, t, g, unknown or other
  modified_base (261)..(261): a, c, t, g, unknown or other
  modified_base (502)..(502): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattccacttcagtggctagtggcatgcactggcctccgccgaggcgtccggggnaagggggctgggaggtgggtggntaaattntagttggtatgaataggaaagtaaataagactagtggtggacctccggaggaacggcctattccgacctatcgtacaggtaacacaactacccgaaagactacgttcttacgtttacctaaccaaataccgaaactacgccgtaggggagaacggggcgaacggaccgtacggactagttacgtattacgtgtagacgtagagacgtacacgtagtagaccggttaaagggtaaacgtttntttacggtcgtttaccggtcgggtaacgggggaccgtaacggggtaccgtacgttaacggtcgtaaacccgtcgttacccgtttcgacccgtacccgtacccgtaaaacccggtccgggtaccccgttaaccgttaccccgggtttccccccgttaaccccggtaccgggtcccccgttaccccggtacggttccccgtacccgggaaacggttacccccgg

SEQ ID NO: 387607 - DNA, 571 bp, Homo sapiens
  misc_feature: GZ8MTXP02I2DZK.22.86.H09.1.454.CMB.2.raw
  modified_base (242)..(242): a, c, t, g, unknown or other
  modified_base (399)..(399): a, c, t, g, unknown or other
  modified_base (495)..(495): a, c, t, g, unknown or other
  modified_base (540)..(540): a, c, t, g, unknown or other
  modified_base (547)..(547): a, c, t, g, unknown or other
  modified_base (557)..(557): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgcaggctccgggcaaggggctggagtgggngcaattatatggtatgatggaaataataaagactaagtgtgactccgtgaagggccgattcaccatctccagagacaactccaaagaaccactctctttacaccaaatcaacagcctggagaggacgaggacacggctagtgtattactgtagcganagatacgacagtagacgttaacggggaaattcgttttagacttcgtacgggtacggggacccaaggggactacgtcggtcctaacgtcttcttacncgtcctcccacgtaacggccctacgtccggttacccttcccccgnggtcccncccggttccnccgtaccgacggcg

SEQ ID NO: 387608 - DNA, 681 bp, Homo sapiens
  misc_feature: GZ8MTXP02INC90.22.86.H09.1.454.CMB.2.raw
  modified_base (194)..(194): a, c, t, g, unknown or other
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgcttcttttaagnggtgtccagtgtcaggtgcagctgggtggagtcgtgggggagcgtggtccagccgtgggacggtcctgagactctcctgtgcagcgtctggattcaccttcagtggctagtggcagtcgcacgtggcctcccgccgacggccgtccggggcgtaaagggggctggggtaggtggggtcgactaagttatagtgggtataggagtaggaaagtaaagtaaagtacgtagtggtacggtacgtcggtaggaacggggtacgtacttaccaaccgtacttacctaccgaagaaccgtaaccgaaacctaccgaaaacgtaaccgttaacccttacgttaccgtttacccaacctaaaacgttacgtaaaccgacggtaccgttaacgggaacggtacgggaccgggaaacgggacgtaaccggggtactaaggttacgttaacgttaaccggtgggttacggaacggtaagtaacggaacgtttaaccgg

SEQ ID NO: 387609 - DNA, 538 bp, Homo sapiens
  misc_feature: GZ8MTXP02H8UMS.22.86.H09.1.454.CMB.2.raw
  modified_base (522)..(522): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaaataaagactaatgtggaactccgtgaagggccgattcaccatctccagagaacaactaccaaagaacactctcgtttcaccaaatgaacagcctgaagaggcgaggacacggacagtgtatactgtgcgagagatcgacatagactaacgggaatcttttagaactctacgtaggggaccaaagggacaacgtcggtacaccgtctcgttcacgcctaccacgacgccacgtccgtcctccccgtgccncctcgcctccgagccg

SEQ ID NO: 387610 - DNA, 749 bp, Homo sapiens
  misc_feature: GZ8MTXP02JDJ03.22.86.H09.1.454.CMB.2.raw
  modified_base (234)..(234): a, c, t, g, unknown or other
  modified_base (260)..(260): a, c, t, g, unknown or other
  modified_base (485)..(485): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcatgcactggcctccgccaggccgtccggganaggggctgggaggtgggtgctaattntagtggtatggataggaaagtaaataagactagtggtacggactaccggtaggaaacgggtccgtaatttccacctactcctaccgaagaacacgtaacctaccgaaacgtaacctaccttcttccgttttaccacctaaaatcgaaacgtacgcctaggaacgaacgggacgtaaacgggaccaacgggtactaagttacgtagttaaccgtgtacgacgaganagtacgaacgtagacgtaacggtaaacggggtaaacttcgttttagacgttacgttacgggtaccggggaaccgaacgggtaacctacggtaccggttacgtaccccgttcttacctaccgtaccgtaccccgttaaccccggaaacccggtaaaaccggggtccccttaacccggttaccccggttacccccgtttaaccccccgcgggggacccccgtttcccccgttacgccccgttaaccccggtaacggggtacccccg

SEQ ID NO: 387611 - DNA, 737 bp, Homo sapiens
  misc_feature: GZ8MTXP02JL44D.22.86.H09.1.454.CMB.2.raw
  modified_base (514)..(514): a, c, t, g, unknown or other
  modified_base (527)..(527): a, c, t, g, unknown or other
  modified_base (722)..(722): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctagtggcatcgcacgtcggcctcccgccgagggccgtccgggagaagggggctaggggacggtggggtaggactaaagtttagtaggttaggtaagtaggtaagtaaggtaaattaaaacgaagtacttagtaggtacggtacgtccggtaggaaccggtccgtaacttaccgaacctacgtaccgtaccgaaagtaaaccgaaccaaacctaaccccgaaaactaacctaaccttcgttaacccgtttacctaaacctaaatacgaacacgtccgtaggacgaggacggacgaccgagacgttagtacgttagttacgngtacgacgaaganacgtacgaacagtaaccggtaaggttaaacgtaaggtttctttaaggaccttacgggaacgggtacccgggggaacgtaacggtaaccgtcggttcgggaacccctttacccgtctacgttcccggaaccctccctaaacgacccgggtaacgtcccaccggttccgtccccctaaccggctacccgtccgtacnccgaccggaacgccc

SEQ ID NO: 387612 - DNA, 598 bp, Homo sapiens
  misc_feature: GZ8MTXP02FNEVI.22.86.H09.1.454.CMB.2.raw
  modified_base (187)..(187): a, c, t, g, unknown or other
  modified_base (302)..(302): a, c, t, g, unknown or other
  modified_base (317)..(317): a, c, t, g, unknown or other
  modified_base (322)..(322): a, c, t, g, unknown or other
  modified_base (371)..(371): a, c, t, g, unknown or other
  modified_base (574)..(574): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttnagtgctatggcatgcactggctccgcaggcgtccgggcaaggggctgggagtgggtgactaaagtttatagtagggtataggataggaaataataaagactatggtagactccgngaagggccattcacnctacncagagaccaactaccaaagacactctcgtttaccaccgaaatcgaacancctgagagggcgacggactacggctagtgtaatactgtgacgagagactacgactagtaggtacgtaaacggggtaaattacgtttagaactcgtacgggtacgggacccgaagggacctacgtcggtaccaccgttctaccgttacgacgtccctaccgaccgacgggcccctaacgtccgttcccgttcccgcgggtcccnccgttcgccgttaccgacggaccg

SEQ ID NO: 387613 - DNA, 631 bp, Homo sapiens
  misc_feature: GZ8MTXP02I6H7D.22.86.H09.1.454.CMB.2.raw
  modified_base (248)..(248): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagctctcctgtgcagcgtctggattcaccttcagtggctatggcatgcacgtggcctccgccgaggcctccgggacgaggggctgggagtgggngactaattatagttggtatgagtaggaaagttaaataaagactagtggtcggtactccggtaggaggcctatcacatctccgaagtacgaacaaccgtaccaaacgtaacctacgtttctacgttttaccaacctaaaagtacgtaaacacgtaccctagggaacgggacggaaccggacgaccacggactaggtacgttaattacgtgtagacgagtagactacgacagtacgtaagtaaacgggtaaagttcgtttagactcgtaccggtagggaccgtaaagggctacgtacgtccgacgtactcgtctacgccctaccgaactacggcctacggtccccgttccgtcccccgagcccgtcgtccgcctacgacggtccc

SEQ ID NO: 387614 - DNA, 881 bp, Homo sapiens
  misc_feature: GZ8MTXP02JON48.22.86.H09.1.454.CMB.2.raw
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagcttgggttttcctcgttgcttcttttaagaggtgtccagtgtcaggtgcagctgggtggagtcgtgggggagcggtggtccagccgtgggacgtccctgagctcgtcctgtgcagcgtctggtattccaccgttcgaggtcggtactagtcggactacgtcggaccaccggtcgggccccgttaccccgggcccggtaacggggtccccgggttaccccgggggaccggtaaacgggggggtccgtttaagggggtaacggggtttccgggggtaacggtaacccgttaaaaggtttttaacgttagggtttagggggtttaacttaaggggttaaagggttaaagggggtaaaaaccgtttaaaaagttaaaaggttacccgtttaaagttacggggttacggttaacccggttaccggggtaaagggtaaacccggggtaccgtaacgtttacccgaacccgttacgtacccgttaaccggaaacgtaaaccggaaaccctaaacccggtaaacctaaaacggtaacccgtaaacctttaccgtttaacggttttaacccaaaacgggtaaaacttaaccggtaaaacgtaaccgtacccggttaacgggaacggttaaccggggaaccgggtaaacggtaaccggacccgggtaacgtaaggttacgttaagttaccggtaggtaccggtaggaaggtaacggacgtaaaccgg

SEQ ID NO: 387615 - DNA, 703 bp, Homo sapiens
  misc_feature: GZ8MTXP02JV642.22.86.H09.1.454.CMB.2.raw
  modified_base (292)..(292): a, c, t, g, unknown or other
  modified_base (331)..(331): a, c, t, g, unknown or other
  modified_base (336)..(336): a, c, t, g, unknown or other
  modified_base (441)..(441): a, c, t, g, unknown or other
  modified_base (635)..(635): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtggctatggcagtgccacgtggcctccgcgaggccgtccgggagaaggggtctgggaggtgggtggactaattagtagtggtatagagtaggaaataaanaagatagtcgtgtactcggtaggaacggctatcacatcncaganaccactacaaagactacttcgtcttaccacaatacgaacacgctggaggacggacgacggacacggactagtcttaagtacgtgacgaggaagagtactacgaanagtacgaacgtaaagggtaattcgtttagattcggtacgggtacggggaacccgaaaggggtacctacgggttacggtaccccgttaaccgttcccgttacgtttacccggaaccggtacccccgttaacccccggaaacccgggtaacccggttaccccgttaacccgggttcccccggggttttaccccccnccccccgggtttccggacccccggttcccggtacccgtcccggttaaccccgggacggtaaacccccg

SEQ ID NO: 387616 - DNA, 681 bp, Homo sapiens
  misc_feature: GZ8MTXP02JG0GT.22.86.H09.1.454.CMB.2.raw
  modified_base (411)..(411): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctagtggcatgcactggctccgccaggccgtccgggacaaggggtctgggaggtgggtagactaattatagtggtatgaagtaggaaagtaaataaagactagtggtacggaactccggtaggaacggctacgtttacaccgtatccgtacaacgtaacgacctaaaccgtacaaacgaacctaacgttctacgtttacctaactaaaatcggaaaacncggacctaggacggacggtacggaagtaccgacgggtactaggtagttaacttacgtggcgagaggaacgtagaccgaatagtacggtaaacgttaaccggggaaatttcggtttaacgcgttacggtacgggaacgggaacgacggtacgtacgtacggtacctacgttcctacgttacgaccctaccgtacccgaaccggtaccggtcccttaccggttcccgtcccctcccggcggtccctccgtccgtaacccgtccggacgtccg

SEQ ID NO: 387617 - DNA, 602 bp, Homo sapiens
  misc_feature: GZ8MTXP02I7YXY.22.86.H09.1.454.CMB.2.raw
  modified_base (167)..(167): a, c, t, g, unknown or other
  modified_base (329)..(329): a, c, t, g, unknown or other
  modified_base (343)..(343): a, c, t, g, unknown or other
  modified_base (349)..(349): a, c, t, g, unknown or other
  modified_base (364)..(364): a, c, t, g, unknown or other
  modified_base (368)..(368): a, c, t, g, unknown or other
  modified_base (371)..(371): a, c, t, g, unknown or other
  modified_base (389)..(389): a, c, t, g, unknown or other
  modified_base (591)..(591): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagcctgggaggtccctgagactctcctgngcagcgtctggattccaccttcagtggctagtggcatgctacgtggcctccgccgagggccgtccgggagaggggctgggaggtgggtgactaagttatggtgtatgagtaggaaagtaataaagactatggtagacctcggaggacggctatcgactatcncaagacacacacanacactntccgttacacaagtnaacngcnggacgaggacgagcacgntagattacttgaggtcgagagatcgacgatagacgtaacggttaaagggtattcgtttagtcgtacgtcgggtaacggggacttaaacgggacttcggtacggtacctaccgttcccgtagttacccgaccgtaccccaacccggtaaccgaaccgggttccctacgtcccgttcccgttcccgcgtccctaccgcgtaccncgaacggaccg

SEQ ID NO: 387618 - DNA, 722 bp, Homo sapiens
  misc_feature: GZ8MTXP02FKANK.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcagcgtctggattcaccttcagtggctatggcatgcactggctccgccaggctccgggcaaggggctgggagtgggtggcaattatagtggtatgatggaaagtaaataaagactaatggtaggactccggtaggaaacgggtccgattccgactactctccagacgaacaactccaaagaaacctactcttacgtttcctacctaaaatgaaaccacgccctggaacgacgggacgaaggaccaacggcgtaagtagttaatttaacgtggtacggacggaggaagtaacgtacgtaacgagtacggtaaaccgtaaacggggtaaaagtttccgttttagactaccggttacgggtggggaacccggaaaggggtacccgtaagtcgggttaccgaaccccggttcttacccgttcctaaccggtcccccgttaccccggtaaaccgaaacccggggtccccttaaccggttcccgggtttacccccttcccccccggtacggggtcccccgtcccccgttcgggttccctaaccccggacggggaaccccg

SEQ ID NO: 387619 - DNA, 588 bp, Homo sapiens
  misc_feature: GZ8MTXP02JR8UJ.22.86.H09.1.454.CMB.2.raw
  modified_base (192)..(192): a, c, t, g, unknown or other
  modified_base (210)..(210): a, c, t, g, unknown or other
  modified_base (249)..(249): a, c, t, g, unknown or other
  modified_base (288)..(288): a, c, t, g, unknown or other
  modified_base (295)..(295): a, c, t, g, unknown or other
  modified_base (303)..(303): a, c, t, g, unknown or other
  modified_base (328)..(328): a, c, t, g, unknown or other
  modified_base (396)..(396): a, c, t, g, unknown or other
  modified_base (499)..(499): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagnggtgtccagtgtcaggtncagctggtggagtcgtgggggagcgtgtccagccgtggngtcctgagactctctgtgcagcgtctggacttcaccttnagtgctnggcatgcncgtggctccgcgtaggcgtccgggngaggggtctaggggaggtcgggtgactaagttatagtggtataggattagggaaagtaaagtaaacgngtaaagtggtaggtacgtcggtaggtaaacggcgtattcgactactctcagaacgaaccacgactaagaactaccttcgtattacaacgtaaatcgtaaaccncgaccgtacggaaggacggggacgaaacggacgaacggtacgaagtttgaacgtttacacgggttagacggttaagacgttaagaccgg

SEQ ID NO: 387620 - DNA, 640 bp, Homo sapiens
  misc_feature: GZ8MTXP02GCABX.22.86.H09.1.454.CMB.2.raw
  modified_base (226)..(226): a, c, t, g, unknown or other
  modified_base (251)..(251): a, c, t, g, unknown or other
  modified_base (397)..(397): a, c, t, g, unknown or other
  modified_base (401)..(401): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctagtggcatgcactggctccgcaggcctcgggnaaggggctggagtgggtggcaattnatggtatgatggaataataaagactatgtaggactccgtagaaggccgattacaccgatctccaagacgacaactccaaagactactctacgtttctaccaaatgaacagctggagaggacgagactaggacagttacgtattacngtanccggaagaagagttacgaacgtagtacgtaacgtaaaccgggggtaaattccgttttaaggtactccgtttaacggggtacggggaccccgtaaaagggggacccctaaggttcgggttaaaccccaccgtttaccgtacgttacgtaccgtaccctaacccgaaccgtaaccgggtaccctaccgttcccggtaccctcccgtacggcccgtaccctcggtacctaccggacgtaccg

SEQ ID NO: 387621 - DNA, 609 bp, Homo sapiens
  misc_feature: GZ8MTXP02H2RSF.22.86.H09.1.454.CMB.2.raw
  modified_base (230)..(230): a, c, t, g, unknown or other
  modified_base (394)..(394): a, c, t, g, unknown or other
  modified_base (418)..(418): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccacctttcagtggctatggcatgcactggctccgccaggctccggganaaggggctggagtgggtggcaattatatggtatgataggaaagtaataaagactatgtggactccggtggaagggccgtatcaccatctaccagagaccaactaccgaaagactactcttcgtttacctaccaaatagaacacgcctgagaggcggaagcgagngacgtgtatcgtgtagcggagagntacgactaagtacgagttaaaccgggaaattccgtttaagcgttacgtcgggttacggggaccgtaacgggactacgtcggttactacccgttcttaaccttcgccgtaaccctcccgaaaccggtaaacggcccctacgttcccggtcccctccccgtcggacccgtccctcgtaccgtcgaacggcccg

SEQ ID NO: 387622 - DNA, 679 bp, Homo sapiens
  misc_feature: GZ8MTXP02IZSH1.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacaggggactcaccatggagtttgggctgagctgggttttcctcgttgcttcttttaagaggtgtccagtgtcaggtgcagcgtggtggagtcgtgggggaggcggtggtccagccgtggggaggtccctgagactctcctgtgcagcgtctggattcaccttcagtggctatggcatgcactggcctccgccgaggccgtccgggacgaggggctgggacgtggggtaggctaagttatagtggttataggagttagggaacggttaaataaaacggtacgttaagttggggttacgtaaaccgttcccgggttaggaaacggggtacccgttaacgttacccgaaacccgtacttccgttaacccgaggaaaccgaaccgaacccttaaccgaaacgaaacctaccttaccttcggtttaccctaacccggtaaattacgaacgaccggttacgacggtaacgggaagaccggaaacgggtaccacgggaccgtaggttacgttaacgttacgtgacggtacgaagtacgacgtaccgagtacgtacggtaacggtaaacgggg

SEQ ID NO: 387623 - DNA, 667 bp, Homo sapiens
  misc_feature: GZ8MTXP02IKBGV.22.86.H09.1.454.CMB.2.raw
  modified_base (201)..(201): a, c, t, g, unknown or other
  modified_base (239)..(239): a, c, t, g, unknown or other
  modified_base (272)..(272): a, c, t, g, unknown or other
  modified_base (275)..(275): a, c, t, g, unknown or other
  modified_base (422)..(422): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacactggaaccngcagtgatggttggtgttataactatgtctctgtacangcaccaggcaacgccccagactcatcgtattancgntcgacaagtaacgccggtaccctggacgggtccctgtactcgtccttcgtctggtccctacgtaaacgtctaccggacctaaccgaccggtccctcccgagaccctgttcctcggacgggtcctacccgagggtcctagggacggtntacgggtagtaccgttaagtaactttaaactaccgttcgtaacttaaccttacgaattacgtacggcgacggggttccacgttaaccggttgttacgggggtacgttccggggacggtacgggaacctggacccgttacggtaacccgtacgggtacgaccgtaaccggaccggacggtccccgtcccgtaccccgtgtaccccgacgtttccccgtaccggtccccctacggttaccccgtccg

SEQ ID NO: 387624 - DNA, 730 bp, Homo sapiens
  misc_feature: GZ8MTXP02ITQYS.22.86.H09.1.454.CMB.2.raw
  modified_base (278)..(278): a, c, t, g, unknown or other
  modified_base (409)..(409): a, c, t, g, unknown or other
  modified_base (698)..(698): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagctctcctgtgcagcgtctggattccacttcgagtggctagtggcagtcgctacgtggcctccggccgacgggtccgtccggggacgaagggggtcgtgggtaggtcgggtgactaagttntagtggtatgagtaggaaataaataagatagtgtacggactcggaggacggcgtacttcgacctatctaccgaagaacgacaacctaccaaacgacctacttacttaccgtttaccaacaaagtacgaacncgtacgtgggagacggggagaaacgggcccgaacggccgttaaagttacgttaacgttagtagggttacggaacgaagacggtaacgtaccgaaagttacgaaccgggttaaaacgtaaacgggggttaaattttccgtttaacggtacgttaaccccggtggggtaacgggaaccccggtaaggggtaccctacgggtttccggacccgtttaccggtacctttcgtaaacctcggtacccctaccgaaccgggtaccgtccccgtacgtcccgttcccgttccccgngacccctcccgtgtacccacggtacggaaccg

SEQ ID NO: 387625 - DNA, 581 bp, Homo sapiens
  misc_feature: GZ8MTXP02GHT0C.22.86.H09.1.454.CMB.2.raw
  modified_base (190)..(190): a, c, t, g, unknown or other
  modified_base (230)..(230): a, c, t, g, unknown or other
  modified_base (281)..(281): a, c, t, g, unknown or other
  modified_base (409)..(409): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggagcgtggtccagccgtgggaggtccctgacgactctcctgtgcagcgtctggattcaccttnagtggctagtggcatgcactgctccgcgagcgtccggganagggctggagtgggtgactaagttatagtggtatagagtacggaaataaanaaagctaagtgagactcgtaggacgcatcacatcgtcagacgacacctacaaagactcgttctacgttaccactaaatacgaactacgctggagacggtacgaagcctaaggcagttacgattacggngagagaagacgtactacgaagtagtacgaaacggtaacggtaattgtttagacgtcggtacgggacggaaccgaaggctacgtcgtacctaccgtactcgtacacccgtacctaccgaccggacgtcctacgtccgtacccgtcccgtcgcctaccgcgccgacgtacgccg

SEQ ID NO: 387626 - DNA, 735 bp, Homo sapiens
  misc_feature: GZ8MTXP02F2Z1Z.22.86.H09.1.454.CMB.2.raw
  modified_base (329)..(329): a, c, t, g, unknown or other
  modified_base (371)..(371): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagccgtgggacgtcctgacgactctcctgtgcagcgtctggattcaccttgagtggctatggcatgcactgctcgcgaggctccgganaaggggtctaggagtggggtcgacaatttagtagtgggtaanggtagtagggtaaacctaaataaaaggtacttaagtagggttacggaacttccgggtaggaaacgggggtaccccgaagtttacaaccccgtaattccccggtacctaaaagggtaacgaaaccgtaaacccgttacccaaaaacgggtaaaaacctaacccggtttacccttaaggtttttaccctaaaacccgaaaaaattacgggaaaacccctaagggttacccctaggtaaaaccggggtaggggaaacccggaaaggtttaaaccggaaccccgggggttaaactaacggtttaaagtttaacgtttaaacggtacgggtacgtaacggtaaaacggaacggttaaacccggtaaacg

SEQ ID NO: 387627 - DNA, 691 bp, Homo sapiens
  misc_feature: GZ8MTXP02IUREX.22.86.H09.1.454.CMB.2.raw
  modified_base (365)..(365): a, c, t, g, unknown or other
  modified_base (687)..(687): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtggggggaggcgtggtccagcctggggaggtccctgagactctcctgtgcagcgtctggattccaccttcagtggctatggcatgcacgtggcctccgccgacggccgtccggggacgaagggggtcggtggggggtggggtggactaattaagtagttggtaatggtagtaaggaaagtaaaataaagactagtggtacggaccgtccggtaggaacggggcctagttaccacctactaccncgaagacgaaccaacctaccaaacgaacctaccttcttcgtttaccctaaccaaatacgaaacgtaccgtacgtacggagggagggaccggaacggaccgacgggctaggttattaacgttagtcggtagcggaagatacgcgaataggtacgtaacggtaacgggtaagttcgtttaggacttcggtccgggtagggggaacccgaaggtaccgtacgtcggtaaccctccgttacctcgtacacccgtccaacccggacgaacccgtccgtcgtcccgttccccgtcccgtcggacccctctcggaccctacggcgtacncccg

SEQ ID NO: 387628 - DNA, 700 bp, Homo sapiens
  misc_feature: GZ8MTXP02GTYXQ.22.86.H09.1.454.CMB.2.raw
  modified_base (239)..(240): a, c, t, g, unknown or other
  modified_base (245)..(245): a, c, t, g, unknown or other
  modified_base (262)..(262): a, c, t, g, unknown or other
  modified_base (272)..(272): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatcctcctacacgtggaaccagcagtgatgttggtgttatactatgtctctgtaccanncaccnggacaacgccccagacncatctattangtctgtacaagtaacgccggtccctcgacggggtccctagactccgtctttccgtcgtcggccttaccgtaaggttcctaccgggtaccaaacccgtaccggtcccccttacccgtacgaaccctacgtccgttccgtcggggcccttccgaacgggtcgtaggaaacgtagttcggaacgtcgttagtaactttacgtttacgcgttacgtcgtaccttcttaacggtttcggaccggtacggtcccgtaacccgttaccggttcgggttacgggggttcggttacccggggacggggtaaccggacccgtaacggtccgttaccggtaccgttcccggtaaggtcccgaccgaccgtaccggcccgttcccggtacccccgtcggtcccaccgtttccgcccggttccccaccccgttctacccgg

SEQ ID NO: 387629 - DNA, 603 bp, Homo sapiens
  misc_feature: GZ8MTXP02GNLKU.22.86.H09.1.454.CMB.2.raw
  modified_base (176)..(176): a, c, t, g, unknown or other
  modified_base (387)..(387): a, c, t, g, unknown or other
  modified_base (445)..(445): a, c, t, g, unknown or other
  modified_base (492)..(492): a, c, t, g, unknown or other
  modified_base (502)..(502): a, c, t, g, unknown or other
  modified_base (537)..(537): a, c, t, g, unknown or other
tcagacatacgcgtcacgaccggtgctcgatttagtgctatagacttggggtttggggggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctgggtggagtcgtgggggagcgtggtccaggccgtgggacgtccctgacgtacttcgtcctggtcgcagtcgtctggtacttccacccttgaaggtcggactagtggacagtgacacgtgcctccgccgaggcccgtacgggacgaaggggctagggagggttgggtacataaagttagtagtagtacngagttaaggaaaactaaagagtctatcgacgtactacggagacgtcgattaccaactntcgaaccagactaaaccaagtaccaaagactctcttattaaccccanaaatgaaacnccgtagacggaagacggacgaaggacaaccgggtntagttatacgtcgagacgacgagtaacaaccgtagaactacgacggtaaaacggtacgtaagttcg

SEQ ID NO: 387630 - DNA, 924 bp, Homo sapiens
  misc_feature: GZ8MTXP02I5ZUK.22.86.H09.1.454.CMB.2.raw
  modified_base (174)..(174): a, c, t, g, unknown or other
  modified_base (192)..(192): a, c, t, g, unknown or other
tcagacatacgcgtcacgaccggtgctcgatttagtgctatagacttgggtttggggggagaggagcccagcactagaagtcggcggtgtttccattcggtgatcagcactgaacacagaggactcaccatggagtttggctgagcttgggttttcctcgttgctcttttaagnggtgtccagtgtcaggtncagctggtggagtcgtgggggagcgtggtccaggccgtggggacgtccctgacgtacctctccgtggtcgcaggtccgtcgtcggtacttccaccttgaggtcggctagtggccagtcgacctacgttcggaccgttccccgccggaacgggtccccggttcccgggggacggtaaaacgggggggtcccgttaagggggtacgggtttcgggggtacggtaaccgtaaaagtttttacgtacgggtttaggggtttaaagttcgggtaaaaggtttaaacggggtaaaaaacggtttaaaacttaaaacgggggttacccttttaaaggggtttacggggttaccggggtaaaacccccggttttacccggggttaaacgggggtaaaaccggggtacccccggttaaacttttaaccccggaaaccctaaaccggtttaccctaaaccccggtaaaggaacccggtaaaacctaaaccccgttaaacccgaaaacgtaacccttaaccgtttaccgttttaccgtttaacccttaaaccgtaaaacgtacggtaaaaacccgaccggtaacgtaacggggaacgggtaaaccgggaccgggtaaaacgggaaccgtacgggtacgttacggtttaacgtttaacgttacggtacggtacggtaacgtagaacgtaacgtacggtaaacgtaacggtaacggttaaacggtaaacggtttaaacgtttacg

SEQ ID NO: 387631 - DNA, 671 bp, Homo sapiens
  misc_feature: GZ8MTXP02GVLM7.22.86.H09.1.454.CMB.2.raw
  modified_base (637)..(637): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggagtccctgagactctcctgtgcagcgtctggattcacttcagtgctagtggcatgcagtggctccgcgaggccgtcggacgaaggggcttgggagtgggtcgactaattatagtggtatagataggaaataataaagctagtgtggacctcggtagaacggtcctatccgacctatctaccgaagacgacaacgtaccaaagtacacttctcgttaccaacaaatgaacacggacctggggacgaacgggacgaacggaccgtaacggtactaaggttacgtaaagttccggtagtacggacgtaagtacgacgtacccgtaaagtacgtaacggtaaccggttaaaagggtaacctttggttttacgaacgttccgtacgggtaccggggaacgtaaacggtaccggtacgtacgtacgacccgttctaaccgttccgaacggttcccaccgaaaccgtaacggtccctacgttcccggtccttccccggngtaccccggtcacggtccccgtaagacggtaccc

SEQ ID NO: 387632 - DNA, 538 bp, Homo sapiens
  misc_feature: GZ8MTXP02HA7YN.22.86.H09.1.454.CMB.2.raw
  modified_base (216)..(216): a, c, t, g, unknown or other
  modified_base (445)..(445): a, c, t, g, unknown or other
  modified_base (509)..(509): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctanactggaaccagcagtgatggttgtggttaataactatgtctctagtaccaacacgcaccaggcaaaacgccccagactcatcattatgctagtcaaataacgcgccctcgacgggtcccccagactcgcttctctcggctccaaagtctggtaccaaacaccggccctcccgtcaaccctatccgtactcgggctccgaaggctagagatgagtctagattaatacgtnccgtgccttgaatttgacgtgccgtctacttagttcgggtaggttcggcgggaagaccgtaagngtagacccgttcgagtaccacgacgaacg

SEQ ID NO: 387633 - DNA, 614 bp, Homo sapiens
  misc_feature: GZ8MTXP02FNA1M.22.86.H09.1.454.CMB.2.raw
tcagacatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctgggtggagtcgtgggggagcgtggtccagcctgggaggtccctgagctctcctgtgcagcgtctggattcaccttcagtggctatggcagtgcactggctcccgccaggcctccggggcaaaggggctgggaggtggggtggacaagttatagtggtaatgataggaaagtaaataaaagactaagtgtaggacgtccggtagaaggggaccgtatttaccgaacttctacccaaggaaacgaactaaacctacccgaaaagaaaccaacttacttcgtttactacccaaaattacggaaactaagcctaggaaggacgggacggaacgggaccgaaccgggacacgttaggttaacttaacgtggttacgacggaagaacggtaacgtacggaaacc

SEQ ID NO: 387634 - DNA, 645 bp, Homo sapiens
  misc_feature: GZ8MTXP02FJCY3.22.86.H09.1.454.CMB.2.raw
  modified_base (226)..(226): a, c, t, g, unknown or other
  modified_base (245)..(245): a, c, t, g, unknown or other
  modified_base (355)..(355): a, c, t, g, unknown or other
  modified_base (410)..(410): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggagtccctgagactctcctgtgcagcgtctggattcaccttcagtggctatggcatgcactggctccgcaggctccgggngaaggggctgggagtgggnggcaattatagtggtatgtataggaaataaataaagatatagtggacgtcgtggaacgggcattcacatctcagacgacaactacaaagacactactcttactaccaaanactaacacgtctgaggacggacgaagacgacggtcgagtagttactagtgtacgngagagcacgacatagaacgttaaacgggtaattcgttttagaacgttcgtacgggtacgggaacccgtaaaggggacctacgtacggtaccgtaccgttaccgtaccgtttccgaaccgtccctacccgtaaacccgggaaccgtaccccgttaacgttccccggttacccccgttaacccccgggtcggtaccccgggtcccccttacggcccttaaccgggacgtaaccccgg

SEQ ID NO: 387635 - DNA, 693 bp, Homo sapiens
  misc_feature: GZ8MTXP02GANX5.22.86.H09.1.454.CMB.2.raw
  modified_base (359)..(359): a, c, t, g, unknown or other
  modified_base (665)..(665): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattccaccttcagtggctatggcatgcactggctccgccgaggccgtccgggacgaaggggctgggagtgggtggactaattatagtaggtatgagtaggaaagtaaataaagactagtgtacggactccggtaggacggccgtataccacctatctacgaagacgacaacctaccgaaanaactacttcttaccgttacctaccaaaatcgaaacacggcctaggacggacgggacgaacggaccgacggcgtaacggttagttaaacgttaccgtggacggaaccggaagtaaacgtacgttacgaaaccgtaagttacggaaccggtttaaaaggggtaaactttccgttttagacccgttacgttacggggacggggaaaccctaaagggggtaccctacggtacggtaccctaaccgtttcctactaccgaacgtccccctaacggaaccgacggtcccctacgttcccgtcccttccccgnggccctcccgtacgcctaccggacggcc

SEQ ID NO: 387636 - DNA, 705 bp, Homo sapiens
  misc_feature: GZ8MTXP02GD7LP.22.86.H09.1.454.CMB.2.raw
  modified_base (228)..(228): a, c, t, g, unknown or other
  modified_base (247)..(247): a, c, t, g, unknown or other
  modified_base (257)..(257): a, c, t, g, unknown or other
  modified_base (264)..(264): a, c, t, g, unknown or other
  modified_base (437)..(437): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggcctccgggnaaggggctgggaggtgggnggacaattanatggtanagataggaaagtaaataaagactagtggtaggtactccggtaggaaacgggccgtattaccgacctatcctaccgaagaacgaaccaacctacccaaagaacctaacttctcgtttaccaccaaaattacgaaacacgtccgtaggacgacgggacgaaaggaccgaacggtntaagtacgttagttacgttaggacgacgaagagacgttaaccggaacgtaagtaaccggtaaacgttaaaccgggggtaaatttccgttttagaactttcgtacgggacgggtaaaccgaggggaacctacggtacggtacctacccggtcttaccgtacgaccggtacccttacccgaaaccgaaccgggtcccaaacggtttccccggtaccccttccccggtcgggaccccgtcccctcgggtaccaccccggtaggaaccccgg

SEQ ID NO: 387637 - DNA, 609 bp, Homo sapiens
  misc_feature: GZ8MTXP02JKEPT.22.86.H09.1.454.CMB.2.raw
  modified_base (286)..(286): a, c, t, g, unknown or other
  modified_base (367)..(367): a, c, t, g, unknown or other
  modified_base (515)..(515): a, c, t, g, unknown or other
  modified_base (525)..(525): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggttgtccagtgtcaggtgcagctggtggagtcgtgggggagcgtggtccagcccgtggggacggtccctgagactctccgtgtggcagctccnggattcgaccttcagtcgctatggcatgcagtcggcctaccgccaggtccgtcggccaaggggcttcggggaggtggggtnacgtaattacgtagtgggtataggacttagggtaaataaacaaagtacctaagtgtaggacgtaccggtggaaacgggtcgacgttcaaccactacctacgagacgaactacgtaaccacgaactactctacgtttaccaccgtaaancgtaaaacgngtaccctaggaggtaccggacggaacggaacgtacggaccgtaggtgttaacgttaccgtggtagacgtacggaaggactaacg

SEQ ID NO: 387638 - DNA, 671 bp, Homo sapiens
  misc_feature: GZ8MTXP02HSCDO.22.86.H09.1.454.CMB.2.raw
  modified_base (227)..(227): a, c, t, g, unknown or other
  modified_base (440)..(440): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccagctccggnaagggctggagtgggtggcaagttatagtggtatagagtaggaaagtaataaagtactagtgtagacgtaccggtagaacgggcctatccaacgatctaccagagacaactcaaagaacactctcgttactaccaaatgaacagacctggacgagacgaaggacgtaccggacagtacgtacttacgtagacgagtagagtagtacgactaanacgtaacgtaacggaaaggtctttttagacttcgtacggtacgggtacgaaacggggtaccaacgtcggtacccgtacccgttcgttacccgttacgaccgtccccgtacccaaacccgggcccggggttaccccgtaaacccgtttcccggtacccccgtttccccccggttacggtccccccggacccgttcccgggacccctttacccggtaaccggggtaacccccg

SEQ ID NO: 387639 - DNA, 729 bp, Homo sapiens
  misc_feature: GZ8MTXP02H0G8C.22.86.H09.1.454.CMB.2.raw
  modified_base (678)..(678): a, c, t, g, unknown or other
  modified_base (688)..(688): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcggtggtccagccgtgggaggtccctgagactctccgtgtgcagcgtcgtggattccaccttcaagtgaccttagtcggcatcgcctacgtcggggtccctcccggcccgtacggggcccggttacccggggacgtaaaggggggtccctaggggtaacggggtgggggttacggtaacccgtaaagttttaagtaaggtcggggttaaattacgggaaattgggggttaaaaaacgttaaacgttaaaaaaggctttaaaaggttcgggtacgggtaaaacccgttccggggtacggaaaagggggtaccccgtaagtttacccaaccctaacttacccgggtaccgaaaggaacctaaccaacctaaccgaaaccgaaaccttaccttacttctttacctaaccgaaatacgaaactcgcctaaggagaacgggaccgagggaccgaccgggataaggtntaacgttacngggtagcggaagtagacgtacgaactagtacggtaaaccgg

SEQ ID NO: 387640 - DNA, 599 bp, Homo sapiens
  misc_feature: GZ8MTXP02IF1D5.22.86.H09.1.454.CMB.2.raw
  modified_base (189)..(189): a, c, t, g, unknown or other
  modified_base (350)..(350): a, c, t, g, unknown or other
  modified_base (395)..(395): a, c, t, g, unknown or other
  modified_base (426)..(426): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttnagtggctatggcatgcactggcctccgcgaggctccgggacaaggggctgggagtgggtggacaattagtatggtatgataggaaataaagaaagactagtagtggtaactccgtagaacgggccgtatcaccatctccgagagacaactcaaagacactntcgttacactaaatgaacagtctagagaggcgaagacgtaacggntagtatataaagtgtagagagacgacacganagtacgaacgtaacggtaagttcgttagtacgtacgtacggtacgggacgaacggtacgtacgtcgtaccgtaccgtacgttctaccgaccgtacccgtaaccgaaccgaccggtaccgtaccgttccgtacccgtcccgtcgtcccgtcccgtaccgtacgtccgacgaccg

SEQ ID NO: 387641 - DNA, 295 bp, Homo sapiens
  misc_feature: GZ8MTXP01AOJRT.39.54.E10.1.454.CMB.2.raw
  modified_base (292)..(295): a, c, t, g, unknown or other
tcagtcgcactagtcacgaccggtgctcgatttagatcgtagcagacacacaagggacggatccctgagcgcttctcaggctccagctctgggctgagcgccacctcaccatctccagcctccagtctgaggatgaggctgactattactgtcagacctgggcactggcattcatgtggtattcggcggagggaccaagctgaccgtcctggtcagcccaaggctgcccctcggtcactctgttcccgccctcctcactagtgcgactgagcgggctggcaaggcgcatagnnnn

SEQ ID NO: 387642 - DNA, 301 bp, Homo sapiens
  misc_feature: GZ8MTXP01BI9G8.39.54.E10.1.454.CMB.2.raw
  modified_base (297)..(301): a, c, t, g, unknown or other
tcagtcgcactagtcacgaccggtgctcgatttagatcgtagcagaacacacaaagggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctcgcccctggtcactctgttcccacctctcactagtgcgacgagcgggctggcaaggcgcatagnnnnn

SEQ ID NO: 387643 - DNA, 302 bp, Homo sapiens
  misc_feature: GZ8MTXP01C9TDQ.39.54.E10.1.454.CMB.2.raw
  modified_base (298)..(302): a, c, t, g, unknown or other
tcagtcgcactagtcacgaccggtgctcgattagatcgtagcagacacacaaagggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtctgggtcagcccaaggctcgcccctggtcactctcgttcccgccctcctcactagtgcgactgagcgggctggcaaggcgcatagnnnnn

SEQ ID NO: 387644 - DNA, 301 bp, Homo sapiens
  misc_feature: GZ8MTXP01C66DF.39.54.E10.1.454.CMB.2.raw
  modified_base (282)..(282): a, c, t, g, unknown or other
  modified_base (298)..(301): a, c, t, g, unknown or other
tcagtcgcactagtcacgaccggtgctcgatttagatcgtagcagaacacacaaagggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtctgggtcagccaaggctgcccctggtcactctcgttcccgccctcctcactagtgcgactgagcgggntggcaaggcgcatagnnnn

SEQ ID NO: 387645 - DNA, 304 bp, Homo sapiens
  misc_feature: GZ8MTXP01DVW6I.39.54.E10.1.454.CMB.2.raw
  modified_base (282)..(282): a, c, t, g, unknown or other
  modified_base (298)..(304): a, c, t, g, unknown or other
tcagtcgcactagtcacgaccggtgctcgatttagatcgtagcagaacacacaaaggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctggtcagcccaaggctcgcccctcggtcactctcgttcccgccctctcactagtgcgactgagcggntggcaaggcgcatagnnnnnnn

SEQ ID NO: 387646 - DNA, 304 bp, Homo sapiens
  misc_feature: GZ8MTXP01DSTFP.39.54.E10.1.454.CMB.2.raw
  modified_base (299)..(304): a, c, t, g, unknown or other
tcagtcgcactagtcacgaccggtgctcgatttagatcgtagcagaacacacaaagggggacgggatccctgagcgcttctcaggctccagctctggggctgagcgccacctcaccatctccagcctccagtctgaggatgaggctgactattactgtcagaccgtggggcactggcattcatgtggtattcggcggaggacaagctgaccgtcgtggtcagccaaggctcgcccctcggtcactctcgtcccgccctcctcactagtgcgactgacggcggctggcaaggcacatagnnnnnn

SEQ ID NO: 387647 - DNA, 309 bp, Homo sapiens
  misc_feature: GZ8MTXP01CAX8Q.39.54.E10.1.454.CMB.2.raw
  modified_base (258)..(258): a, c, t, g, unknown or other
  modified_base (301)..(301): a, c, t, g, unknown or other
  modified_base (304)..(309): a, c, t, g, unknown or other
tcagtcgcactagtcacgaccggtgctcgattagatcgtagcagacacacaaagggggacgggatccctgagcgcttctcaggctccagctctggggctgagcgccacctcaccatctccagcctccagtctgaggatgaggctgactattactgtcagaccgtggggcactggcattcatgtggtattcggcggagggaccaagctgaccgtccgtgggtcacgccgaaggcctcgcccctggtcactctcgtcccncctctcactagtgcgactggacgcgggctggcaaggcgactanagnnnnnn

SEQ ID NO: 387648 - DNA, 299 bp, Homo sapiens
  misc_feature: GZ8MTXP02GKKB7.39.54.E10.1.454.CMB.2.raw
  modified_base (296)..(299): a, c, t, g, unknown or other
tcagtcgcactagtcacgaccggtgctcgatttagatcgtagcagacacacaaaggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctgcccctggtcactctgttccccgcctcctcactagtgcgactgagcggctggcaaggcgcatagnnnn

SEQ ID NO: 387649 - DNA, 300 bp, Homo sapiens
  misc_feature: GZ8MTXP02G487A.39.54.E10.1.454.CMB.2.raw
  modified_base (299)..(300): a, c, t, g, unknown or other
tcagtcgcactagtcacgaccggtgctcgatttagatcgtagcagaacacacaagggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtctgggtcagcccaaggctcgcccctcggtcactctgttccccgccctcctcactagtgcgactgagcggctggcaaggcgcatagnn

SEQ ID NO: 387650 - DNA, 299 bp, Homo sapiens
  misc_feature: GZ8MTXP02IDKKF.39.54.E10.1.454.CMB.2.raw
  modified_base (297)..(299): a, c, t, g, unknown or other
tcagtcgcactagtcacgaccggtgctcgatttagatcgtagcagaacacacaaagggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgcccctggtcactctgttcccaccctctcactagtgcgactgagcgggctggcaaggcgcatagnnn

SEQ ID NO: 387651 - DNA, 299 bp, Homo sapiens
  misc_feature: GZ8MTXP02FGYMJ.39.54.E10.1.454.CMB.2.raw
  modified_base (299)..(299): a, c, t, g, unknown or other
tcagtcgcactagtcacgaccggtgctcgatttagatcgtagcagaacacacaaaggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgttcccaccctcctcactagtgcgactgagcgggctggcaaggcgcatagn

SEQ ID NO: 387652 - DNA, 295 bp, Homo sapiens
  misc_feature: GZ8MTXP02IKJL7.39.54.E10.1.454.CMB.2.raw
  modified_base (285)..(285): a, c, t, g, unknown or other
  modified_base (291)..(295): a, c, t, g, unknown or other
tcagtcgcactagtcacgaccggtgctcgatttagatcgtagcagaacacacaaagggggacgggatccctgagcgcttctcaggctccagctctggggctgagcgccacctcaccatctccagcctccagtctgaggatgaggctgactattactgtcagacctgggcactggcattcatgtggtattcggcggaggaccaagctgaccgtctggtcagcccaaggctcgcccctgtcactctgttcccgcctctcactagtgcactgagcggctggcaaggcncatagnnnnn

SEQ ID NO: 387653 - DNA, 305 bp, Homo sapiens
  misc_feature: GZ8MTXP02I7GB3.39.54.E10.1.454.CMB.2.raw
  modified_base (301)..(305): a, c, t, g, unknown or other
tcagtcgcactagtcacgaccggtgctcgatttagatcgtagcagaacacacaaagggggacgggatccctgagcgcttctcgggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctcgcccctggtcactctgttccccaccctcctcactagtgcgactgagcgggctggcaaggcgcatagnnnnn

SEQ ID NO: 387654 - DNA, 540 bp, Homo sapiens
  misc_feature: GZ8MTXP01ELTNL.15.55.E11.1.454.CMB.2.raw
  modified_base (347)..(347): a, c, t, g, unknown or other
  modified_base (402)..(402): a, c, t, g, unknown or other
  modified_base (412)..(412): a, c, t, g, unknown or other
  modified_base (430)..(430): a, c, t, g, unknown or other
  modified_base (458)..(458): a, c, t, g, unknown or other
  modified_base (493)..(493): a, c, t, g, unknown or other
  modified_base (512)..(512): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacaggccgtggggggtccctgagactctcctgtgcagcctcaggattcgcctttcgcatctatgccatgacctgggtccgccaggctccgagggaaggggctggagtggatctcagctattagnggaggtggtagtggtagaaaacacaatattaacgcaaggctccgtgaaggggccnctcatcatcnccagagacaattccaaanaacactactttatcttacaaatgaaacngcctgacgagccgagacacgggcctaatacttacngttgcgagagcttcgaacnggcccgtgggacgcccgttgaacgtcgg

SEQ ID NO: 387655 - DNA, 787 bp, Homo sapiens
  misc_feature: GZ8MTXP01BWYC1.15.55.E11.1.454.CMB.2.raw
  modified_base (215)..(215): a, c, t, g, unknown or other
  modified_base (283)..(283): a, c, t, g, unknown or other
  modified_base (311)..(311): a, c, t, g, unknown or other
  modified_base (327)..(327): a, c, t, g, unknown or other
  modified_base (339)..(339): a, c, t, g, unknown or other
  modified_base (371)..(371): a, c, t, g, unknown or other
tcagtctacgtagccacgaccggtgctcgatttagcactcgcacgttgggtttgggctgaactggctttttcttgtggctattgtaaaaaggtgtccaatgtgaggtgcagctgttggagtctgggggaggcttggtacagcctggggggtccctgagactctcctgtgcagcctcaggattcgcctttcgcatctatgccatgacctgggtccnccaggctccgaggggaagggctggagtggatctcagctattaggtggaggtggtagtggtagaaaacncatattacgcaggctcgtgaacgggccncttcaccatcacaganacaattccaaanaacactactttatccttacaaaagtgaaaccncgaccctaggccggacggacccggtaaacgggacccgtaccgggtaccgttaaataaccgtacgtggtacggacggaagaacgacgtaaccggaaaccggcgggtccccgggtagggaccgtacccggttagaacccggttacgggggtacgggggaacccgtaaccggggtaaccccgttcgggtacccctacccggttcccttacccctaacccgtaaacccccgtaccccgaaacccgggtaaacccggggtcccccttaaccggtttcccccgggtttaccccccgttacccccccgtaccgggtaaccccccttaaccccccgttccccgttaaaccccgaaacggtccccgtaaccccgtaaccccgggtccgggggttaccggggaaccccttaacccgggtcccgggg

SEQ ID NO: 387656 - DNA, 559 bp, Homo sapiens
  misc_feature: GZ8MTXP01AMMMD.15.55.E11.1.454.CMB.2.raw
  modified_base (308)..(308): a, c, t, g, unknown or other
  modified_base (378)..(378): a, c, t, g, unknown or other
  modified_base (409)..(409): a, c, t, g, unknown or other
  modified_base (419)..(419): a, c, t, g, unknown or other
  modified_base (425)..(425): a, c, t, g, unknown or other
  modified_base (448)..(448): a, c, t, g, unknown or other
  modified_base (464)..(464): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtctgggggaggcttggtacaggccgtggggggtccctgagactctcctgtgcagcctcaggattcgccttcgcatctatgccatgacctgggtcccnccaggctccgaggggaggggctgggagtggatctcagctagttaggtggaggtggtagtgggtagaaacncaatattacgcagggctccgtgaacgggccncttcacatcnccaganacaatccaaacacactactttancttacaaatcgaaacngacctgacgacgccgaggaaccacggcccgtattaccgtacgtgttcgcgaaggcgagtccgaaacgccgggccccggtggggaacgtccccggg

SEQ ID NO: 387657 - DNA, 596 bp, Homo sapiens
  misc_feature: GZ8MTXP01C9OQM.15.55.E11.1.454.CMB.2.raw
  modified_base (375)..(375): a, c, t, g, unknown or other
  modified_base (433)..(433): a, c, t, g, unknown or other
  modified_base (459)..(459): a, c, t, g, unknown or other
  modified_base (501)..(501): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttcctccgtccccccttcgcagtaacaccaagtacagaatattaacctgttcccatcgactacgccttcggcctcgccttaggggcactcaccctgccccgattaacgtgacagaccctggtcttcggcgagcgggtctttcacccgtntttatcgttacttatgtcagcattcgctcttctgaactaccctccagcatgcctcacngcacaccttcacagcttacagaaccnccctacccctaccaaacacgacaataacgcgtcgactcgccncacgtcttcgggtcactacgttcggtttaacgtccccgtttcgttacttcccgttaaccccgcctaattccctggaacgtccgttaacggtaacg

SEQ ID NO: 387658 - DNA, 576 bp, Homo sapiens
  misc_feature: GZ8MTXP01EE70B.15.55.E11.1.454.CMB.2.raw
  modified_base (237)..(237): a, c, t, g, unknown or other
  modified_base (280)..(280): a, c, t, g, unknown or other
  modified_base (571)..(571): a, c, t, g, unknown or other
  modified_base (573)..(573): a, c, t, g, unknown or other
tcagtctacgtagccacgaccggtgctcgatttagcactcgcacgttgggtttggggaggcttggtacagcctgggggtccctgagactctcctgtgcagcctcaggattcgcctttcgcatctatgccatgacctgggtccgccaggctccagggaaggggctggagtggatctcagctattagtggaggtgttagtggtagaaaacacatattacgcaggctccgtgaagggccncttcaccatctccagagacaaattccaaacaacactactttancttacaaaatgaaacagcctgcgagccgaggacacggcctaatactactgtgcgagagatacgaacgaggccccccgtgggagcccgttgacctaacgtggggcccaaggggaacccctgggccacccgtctccctcaacctccaccaacggcccagtccggtcccttccccgtcggcccaccctccctaccaacgacgcctacctcgtcggggccacgacgccggcccgtgggctcgcctggtcaaggcttacgtccgctacgtagacgttgagcggcgtggcgaggcgngngtg

SEQ ID NO: 387659 - DNA, 565 bp, Homo sapiens
  misc_feature: GZ8MTXP01BCHF6.15.55.E11.1.454.CMB.2.raw
  modified_base (443)..(443): a, c, t, g, unknown or other
  modified_base (469)..(469): a, c, t, g, unknown or other
  modified_base (488)..(488): a, c, t, g, unknown or other
  modified_base (490)..(490): a, c, t, g, unknown or other
  modified_base (496)..(496): a, c, t, g, unknown or other
  modified_base (500)..(500): a, c, t, g, unknown or other
  modified_base (502)..(502): a, c, t, g, unknown or other
  modified_base (504)..(504): a, c, t, g, unknown or other
  modified_base (541)..(541): a, c, t, g, unknown or other
  modified_base (544)..(544): a, c, t, g, unknown or other
  modified_base (549)..(549): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaaccagcctacacgcttaaaccgggacaaccgtcgcccggccaacatagccttctccgtccccccttcgcagtaacaccaagtacaggaatattaacctgtttcccatcgactacgcctttcggcctcgccttagggtcactcaccctgccccgattaacgtgacaggaacccttggtcttccggcgagcgggctttcgaccgctttatcgttaacttaactgtcagcattcgcaacttctgataccctccaagcaatcgctcacancacactacacacgctacacaacgacnccctacccaacaacacaanancgcgcncgcncncnctcgtcgctcttgttacgtccgttcgttcttcctccnccnctctnacgtcgttaacgtaag

SEQ ID NO: 387660 - DNA, 582 bp, Homo sapiens
  misc_feature: GZ8MTXP01A9AHN.15.55.E11.1.454.CMB.2.raw
  modified_base (238)..(238): a, c, t, g, unknown or other
  modified_base (278)..(278): a, c, t, g, unknown or other
  modified_base (566)..(566): a, c, t, g, unknown or other
  modified_base (578)..(578): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccncttcaccatctccagagacaattccaacaacacactttancttacaaatgaacagcctgcgagccgagacacggcagtatactactgtgcgagagatcgaacgacggcccggtgggacgcccgttgaacctacgtgggggcccaggggaaccctgggtccacccggtctccctccaacctcccaaccgaacgggcccacgtccggtccttcccccgtcggccacccctcctaccaacgacggcaccgtcgtcggggccacgcgccggccctcgggctcgccgtggcaacggctaccgttccgctacgttagcttgaacggcgggtcgnggcgaaggccgngaag

SEQ ID NO: 387661 - DNA, 516 bp, Homo sapiens
  misc_feature: GZ8MTXP01DAQJG.15.55.E11.1.454.CMB.2.raw
  modified_base (211)..(211): a, c, t, g, unknown or other
  modified_base (238)..(238): a, c, t, g, unknown or other
  modified_base (277)..(277): a, c, t, g, unknown or other
  modified_base (354)..(354): a, c, t, g, unknown or other
  modified_base (388)..(388): a, c, t, g, unknown or other
  modified_base (414)..(414): a, c, t, g, unknown or other
  modified_base (420)..(420): a, c, t, g, unknown or other
  modified_base (433)..(433): a, c, t, g, unknown or other
  modified_base (506)..(506): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtagaaaacncatattacgcaggctcgtgaagggccnttcaccatctccagagacaattccaacaacacactttancttcaaatgaaacagcctgcgagccgaggacacggcgtatactactgtgcgagagatcgaacaggcccccgtgggancccgtgactacgtgggccagggacctgcacgtcnctcacctcacaggccatcgtctcccngcaccnctcagcgcactcngggcacacgcgccgtggctgcctgcaaggcttacttccgacgtacgtagacgttgacgcgggctggcaaggcncgaacgtaag

SEQ ID NO: 387662 - DNA, 654 bp, Homo sapiens
  misc_feature: GZ8MTXP01C4AIE.15.55.E11.1.454.CMB.2.raw
  modified_base (242)..(242): a, c, t, g, unknown or other
  modified_base (258)..(258): a, c, t, g, unknown or other
  modified_base (283)..(283): a, c, t, g, unknown or other
  modified_base (348)..(348): a, c, t, g, unknown or other
  modified_base (649)..(649): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgaggggaaggggctggagtggatctcagctattagtgggaggtgttagtggtagaaaacacatattacgcaggctccgtgaagggccncttcacatctccaganacaattccaaacaacactactttancttacaaatgaacagcctgcgagccgaggacacggcctatactactgtgcgagagatacgaaacncgggccccccgtggggacgtcccggttagaccgttaacggcgggggcccaacggggaaccccttggggtcccacccggttcctccctaccaaccctacccaacccgaacgggcccctacgttcccggtcccttcccccgtcggcccacccctccctaccgaacgaccgccgtacccgtcggtcgggggccaccgcggcccggcccgttcgggccgtcgcccgtcggtccgaacggtaccttaccgttcccgcgtaaccgtacggacgttcggacggcgggcgtcgggcgacgggcgaacgngtaag

SEQ ID NO: 387663 - DNA, 578 bp, Homo sapiens
  misc_feature: GZ8MTXP01BLNWD.15.55.E11.1.454.CMB.2.raw
  modified_base (357)..(357): a, c, t, g, unknown or other
  modified_base (466)..(466): a, c, t, g, unknown or other
  modified_base (504)..(504): a, c, t, g, unknown or other
  modified_base (519)..(519): a, c, t, g, unknown or other
  modified_base (526)..(526): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggaggcttggtacagccgtggggggtccctgagactctcctgtgcagcctcaggtattccgcctttcgcatctatgcctatgacctgggtcccgccaggcctccgaggggaacggggctgggagtggatctcagctagttaggnggtaggtggtagtggtaagaaaacacaaattaacttaacgcagggcctccggtagaacggggcctcttcatcatccacagaacactaatcccaaacaacactactttanacttaacaaagtcgaacagcctagcgagccgtagaccncggctaatacactgngacgaanagcttacggaacacgggcccgtgggaccgttccccggttaagaaccgtcggg

SEQ ID NO: 387664 - DNA, 606 bp, Homo sapiens
  misc_feature: GZ8MTXP01DOFM2.15.55.E11.1.454.CMB.2.raw
  modified_base (472)..(472): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttcctccgtccccccttcgcagtaacaccaaagtacaggaaatattaacctgtttcccatcgactacgcctttcggcctcgccttagggtcactcaccctgccccgattaacgtggacaggaacccttggtcttcggcgagcgggcttttcgaccgtctttatcgttacttatgtcagcattcgctaacttctgaactaccctccagcatcgctcacagcacaccttcacaggcttacagaacccncctaccccaacaaacgaacacaataacgccgtcgctcgccgcacgcgtcgtcgttcgtacgttacggtttacgttcccgtttccgttccttccgttcccgtccctaactctcgttacgtaacgttaacgtaacg

SEQ ID NO: 387665 - DNA, 567 bp, Homo sapiens
  misc_feature: GZ8MTXP01ETO5L.15.55.E11.1.454.CMB.2.raw
  modified_base (211)..(211): a, c, t, g, unknown or other
  modified_base (238)..(238): a, c, t, g, unknown or other
  modified_base (254)..(254): a, c, t, g, unknown or other
  modified_base (357)..(357): a, c, t, g, unknown or other
  modified_base (373)..(373): a, c, t, g, unknown or other
  modified_base (402)..(402): a, c, t, g, unknown or other
  modified_base (456)..(456): a, c, t, g, unknown or other
  modified_base (566)..(566): a, c, t, g, unknown or other
tcagtctacgtagccacgaccggtgctcgatttagcactcgcacggtgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtagaaaacncatattacgcaggctccgtgaaggccncttcaccatctcaganacaatccaacacacactttacttacaaatgaacagcctgcgagccgaggacacggcctatactactgtgcgagagatcgaaacgacggccccccgtggggacncccgttgacctaacgnggggccaagggaccctgggtccaccgtcncctacaacctccacaacggcccagtccggtcctccccgtgccaccctcctcaancgcacctgcggggcacgacgcgcccgtggctcgccgtcggcaaacggtacttacgttccgacgtaaccgtagacgttcgaggccgggcgtcggccgaaggccgcttaagng

SEQ ID NO: 387666 - DNA, 612 bp, Homo sapiens
  misc_feature: GZ8MTXP01APR2G.15.55.E11.1.454.CMB.2.raw
  modified_base (238)..(238): a, c, t, g, unknown or other
  modified_base (255)..(255): a, c, t, g, unknown or other
  modified_base (280)..(280): a, c, t, g, unknown or other
  modified_base (329)..(329): a, c, t, g, unknown or other
  modified_base (345)..(345): a, c, t, g, unknown or other
  modified_base (609)..(609): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaaggggctggagtggatctcagctattagtggaggtggtagtggtagaaaacacatatacgcaggctcgtgaagggccncttcaccatctccaganacaattccaaacaacactactttancttacaaatgaacagcctgcgagccgaggaccacggcctatactactgngcgagagatcgaaacncgggcccccggtgggacgtcccgttgacctaacggcgggggccaggggaacccctgggtccacccgtctcctaccaccctccaaccgaacgggcccacgtccggtcccttccccctcggcccacccctccctaccaacgacgaccgacccgtcggtcgggggccacgcggccggcccgtcgggcctcgccgtcggtcgaacggtaccttaccgttcccgcgtacggtacgacgttggacggcgggcgtcggcgacgggccgcgngtg

SEQ ID NO: 387667 - DNA, 729 bp, Homo sapiens
  misc_feature: GZ8MTXP01A1U20.15.55.E11.1.454.CMB.2.raw
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacagccgtgggggtccctgagactctcctgtgcagcctcaggtacttcgtccttcgctatctatcgccatcgaccgtcgggtcccgccgaggcctaccgagggggaacggggcgtgggagtggatccgtacaggtcttagttaggtggggtagggtgggtaggtaagggttaacgaaacgacgtaaagttaacgtttaccggacgtacggggtacccttacccggggttaggaaaccgggggtccccgtacctttaccgaaacccctacgttacccctacccgaaaggaaccgaacctaaaactttaccccgaaaaactaaaccctaacttaaaccttttaacttaccctttaaacgaaaacgttacgaaaacctcgaccccgtagacccggtaacgacccggaacggggaaccacccgggttaccgtaaacttacgtaacgtgttaggcgaaggaacgagtcccggaaacggcgggaccccgtgggggaacctcccggg

SEQ ID NO: 387668 - DNA, 656 bp, Homo sapiens
  misc_feature: GZ8MTXP01AIHJO.15.55.E11.1.454.CMB.2.raw
  modified_base (266)..(266): a, c, t, g, unknown or other
  modified_base (354)..(354): a, c, t, g, unknown or other
  modified_base (378)..(378): a, c, t, g, unknown or other
  modified_base (507)..(507): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggagcttggtacagccgtggggggtccctgagactctcctgtgcagcctcaggnttcgcctttcgcatcatcgccatcgaccgtgggtcccgccgaggcctccgaggggaaggggctgggagtggatctcagctagttaggnggaggtcggtagtggtagaaaacncaaattactaacgcaagggtcctccggtaggaacggggcctcttaccaccgtatcctaccaaggaacaacctaaattacccaaactaacctactaacttttactacctttaacaaaagttcgaaaaccncgtaccgtggaccgacggaccccgagggaacccgaccgggtaccgttaataaccgtacgttgggtacgacggaaggaacgacgttccgggaaaacgccggggtcccggtgggaaccgtccccggttagaacccgttaacggtccggggg

SEQ ID NO: 387669 - DNA, 687 bp, Homo sapiens
  misc_feature: GZ8MTXP01EA002.15.55.E11.1.454.CMB.2.raw
  modified_base (241)..(241): a, c, t, g, unknown or other
  modified_base (282)..(282): a, c, t, g, unknown or other
tcagtctacgtagccacgaccggtgctcgatttagcactcgcacgttgggtttgggggaggcttggtacagcctggggggtccctgagactctcctgtgcagcctcaggattcgccttttcgcatctatgccatgacctgggtccgccaggctccgagggaaggggctggagtggatctcagctattagtggaggtggtagtggtagaaaacacatattacgcaggctccgtgaagggccncttcaccatctcagagacaattccaaacaacactactttancttacaaatgaacagcctgcgagccgaggacacggcctatactactgtgcgaagagactacgaaacgacggccccccggtgggacgtcccgttagaaccgtaacgtcgggggcccaacggggaacccctgggtacccacccggttctaccctaccaaccctcccaacccgaacgggcccacgtcccggttcccttcccccgtaggccccaccccttcccaccaaacgacgccacccgttcggcgggggaccacgacggccggtccccgtgggggcctcggcctacgggtaccaaacgggtaccttaccggttcccggttactttaaacccggaggttaacccgttggaccgggggtcgggtaccggtaacggggaccggaacgggttccgtaacgttaacgtaag

SEQ ID NO: 387670 - DNA, 678 bp, Homo sapiens
  misc_feature: GZ8MTXP01AU5M3.15.55.E11.1.454.CMB.2.raw
  modified_base (210)..(210): a, c, t, g, unknown or other
  modified_base (238)..(238): a, c, t, g, unknown or other
  modified_base (677)..(677): a, c, t, g, unknown or other
tcagtctacgtagccacgaccggtgctcgatttagcactcgcacgttgggtttgggggaggcttggtacagcctggggggtccctgagactctcccgtgcagcctcaggattcgcctttcgcatctatgccatgacctgggtccgccaggctccagggaaggggctggagtggatctcagctattagtggaggtggtagtggtgaaaacncatattacgcaggctccgtgaagggccncttcaccatctccagagacaattccaacaacacactttatctcaaatgaacagcctgcgagccgaggacacggctatactactgtgcgagagatcgaacagggcccgtggggacgtccgttgaacctacggtcgggggacccaaggggaacccctggggtacccacccggttctccctacaaaccctacccgaacccgaacggggccctaacgtcccggtccctttccccccgtcggaccctacccccgtccctacccgaacgacgcccgtacccgtcggtcgggggccaccgacggcccggccccgtcggggcccttcggcccgttcgggtccgaaacgggtaaccttaacccgttcccggtccttaaccggtaacggaccgttacgggacggccgggggtcgtacgggccgaaacggggccgaccgaacgttaaggng

SEQ ID NO: 387671 - DNA, 584 bp, Homo sapiens
  misc_feature: GZ8MTXP01EO6U3.15.55.E11.1.454.CMB.2.raw
  modified_base (189)..(189): a, c, t, g, unknown or other
  modified_base (212)..(212): a, c, t, g, unknown or other
  modified_base (238)..(238): a, c, t, g, unknown or other
  modified_base (253)..(253): a, c, t, g, unknown or other
  modified_base (264)..(264): a, c, t, g, unknown or other
  modified_base (277)..(277): a, c, t, g, unknown or other
  modified_base (288)..(289): a, c, t, g, unknown or other
  modified_base (295)..(295): a, c, t, g, unknown or other
  modified_base (340)..(340): a, c, t, g, unknown or other
  modified_base (562)..(562): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaaggggctggagtggatctcagctattagnggaggtggtagtggtagaaaacncatattacgcaggctcgtgaaggccncttcacatctcaganacaattccaanaacactactttancttacaaatannacagcncgcgagacgacggacgacgacgtactactactgtagacgagaganacgcaacgacggccgtgggacgcccgtaggactaacgtacgggcgacgggaacccgtcggtccaccgtacctccctaccaaccgtccaccgaacggccctaccgtcggtcctcccctcgccacctccaccaacgacgcgacctacgcggggccgaccgacggccggcccgtcggcgtcgccgtcggtacgacggacttaccgtaccgacttacgcgacgtgnggcggcgcggacgaacggcgcg

SEQ ID NO: 387672 - DNA, 668 bp, Homo sapiens
  misc_feature: GZ8MTXP01BM8IN.15.55.E11.1.454.CMB.2.raw
  modified_base (182)..(182): a, c, t, g, unknown or other
  modified_base (358)..(358): a, c, t, g, unknown or other
  modified_base (360)..(360): a, c, t, g, unknown or other
  modified_base (371)..(371): a, c, t, g, unknown or other
  modified_base (376)..(376): a, c, t, g, unknown or other
  modified_base (381)..(381): a, c, t, g, unknown or other
  modified_base (409)..(409): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccngcctacacgacttaaaccgggacaaccgtcgcccggacaacatacgccttcctcccgtccccccttgcagtaacaccaagtacagaatattaacctgttccatcgactacgcctttcggcctcgccttagggcactcaccctgccccgtattacgtgacacggtaccttgtctcgngngcggtctttcnccgtntttancgtttactatgtcagctattcgctcttntgacttcctcagcatcgcctcacacgacactaccttcacgtacgacttaccacgtaacctcccctaaccccgtaaacccaaccgaaacccgactaaacgtaaccgtccggtaccgtccgttccggtcccgactacggttccgttaaccggttgaccgttacgtttaccggtttaacccggtcccccgttttacgttaccgtttcccctttaacccgccctaacgtttcgtcggttaaccgtccgttaaacgggttccgg

SEQ ID NO: 387673 - DNA, 630 bp, Homo sapiens
  misc_feature: GZ8MTXP01CKRWH.15.55.E11.1.454.CMB.2.raw
  modified_base (400)..(400): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgtggagtcgtgggggagcgttggtacagccgtggggggtccctgagactctcctgtgcagcctcgaggacttcgccttcgcatctatcgccatcgaccgtgggtcccgccgacgggcctaccggagggggaaggggcgtgggagtggatctcgagtctaagttaggtgggaggttggtagtagggtaacgaaacnctaaattagttacgcgacgggtcctacccggtagggaacggggtccctcttaccaacctacttccgtacccaagaccgaaacctaacttaacccaaactaaactaccttaacttttactaccttaaccgaaaatcgaaacacgtccctgacgacgccgaaggaaccacggccgtaattaccgtacgtgagcgagaacagtaacggaacgcgggcccgtgggaacgtcccg

SEQ ID NO: 387674 - DNA, 775 bp, Homo sapiens
  misc_feature: GZ8MTXP01DTA75.15.55.E11.1.454.CMB.2.raw
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtggggaggcttggtacaggccgtgggggtccctgagactctctgtgcagcctcaggacttcgccttcgctatctatgcctatcgaccgtcgggtccccgccgaggcctaccggaaggggaacgggggccgtaggggaaggtgggtactccgtacgagtactttaagttagggtgggtagggttcggtaacggttaggtaaacgaaaacctaactaaattaagttaaccgacgtacgggtcccttacccgggtagggaaccggggtccgtaccctttacccaaacctacgttccctacccgaaagtaaaccgtaaacccttaaacttaacccaaaacctaaacccgttaaaccttaactttttaactaccgtttaaacaaaacgttcggaaaacctcgtacctacggacccgacggaacccggaggaaaccccggtacggtacccgttaataaaccgttacgttggaccggacgaaggtaacgttacgttacccggaaaacggtccggggtaccccgggttgggggacccgtccccggtttagaacccgttcggggtaacccggggg

SEQ ID NO: 387675 - DNA, 812 bp, Homo sapiens
  misc_feature: GZ8MTXP01CXDEG.15.55.E11.1.454.CMB.2.raw
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattagtaaaaggtgtccaatgtgaggtgcagctgttggagtcgtgggggagcttggtacagccgtgggggtcctgagactctcctgtgcagcctcaggtacttcgcctttcgcatctatgccatcgaccgtcggtcccgcgaggcctccggaggggaggggcgtggagtggatcgtcgagtctagttaggtggaggttaggtaggtaggtaacgaaaaaactactaaaagttaacgttaacggcgtaaagggtcccgttacccgggtacgggaaaccgggggtccctacccgttttaccaaccctacgtttccctacccgtaaagggaaacgaaaacctaaactttaccccaaaaacctaaaccctaaaccttaaccttttaaacttaaccctttaaacggggtaaaaactttaacgtaaaacccgaaccgtacccgttaacggaccggaaaccggaaccccggggaaacgggaaaccccgtaccccggggttaacccttaaacggttaaacccctttaacggttacgggttaggacccggaaaggaacggttaccgacgggaaacccggaacccggggtacccgggttaacggggaaccggttccccggttaggtaaccccggttaaccggggtaacccggggg

SEQ ID NO: 387676 - DNA, 685 bp, Homo sapiens
  misc_feature: GZ8MTXP01DF6CZ.15.55.E11.1.454.CMB.2.raw
  modified_base (303)..(303): a, c, t, g, unknown or other
  modified_base (371)..(371): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacagccgtggggggtccctgagactctcctgtgcagcctcaggattcgcctttcgcatctatgccatgacctgggtcccncaggctccgagggaaggggctggagtggatctcagctattaggtggaggtggtaggtggtagaaaacncaaatattcgcaagggctcccggtgaacggggcccgtacttccgaccctaatcctaccaaggaacgaactaaactttacccaaactaaaccactaactttaactacctttaactaaaacttacggaaaaccacggtaccctagggcccgaacgacccgggaacgggtaacccgaaccgggacccgttaaacgtaaccgttaacccgttggttcgaccgaaagggaacgaacgttaccggaaaccgaaccggggtaccccgggtaacgggggacccgtaccccgggtttagaacccgttaacgggtcccgggggg

SEQ ID NO: 387677 - DNA, 651 bp, Homo sapiens
  misc_feature: GZ8MTXP01APPSQ.15.55.E11.1.454.CMB.2.raw
  modified_base (215)..(215): a, c, t, g, unknown or other
  modified_base (280)..(280): a, c, t, g, unknown or other
  modified_base (308)..(308): a, c, t, g, unknown or other
  modified_base (351)..(351): a, c, t, g, unknown or other
  modified_base (367)..(367): a, c, t, g, unknown or other
tcagtctacgtagccacgaccggtgctcgatttagcactcgcacgttgggtttgggctgaactggctttttcttgtggctattgtaaaaaggtgtccaatgtgaggtgcagctgttggagtctgggggaggcttggtacagcctggggggtccctgagactctcctgtgcagcctcaggattcgcctttcgcatctatgccatgacctgggtccncaggctccgagggagggctggagtggatctcagctattaggtggaggtggtagtggtagaaaacncatatacgcaggctccggtgaagggccncttcaccatctccagagacaattccaaacaacactacttttanccttacaaatgaaacngcctgcgagccgagacacggctatactactgtgcgagagatacggaacgacgggcccgtagggacgtcccgttagaccgtacggggtcggggaccgacggggaacccgtcggtacctacccggtcctacccgtaccaacccgtacccgaacccgaaccggggcccctaacgttcccgggttccccttccccccgtacgggtccccttacccccgttcccaccccgaacgtaaccgtccccaaccggttcccgggttccggggggtccaaccggtaaccccgggg

SEQ ID NO: 387678 - DNA, 672 bp, Homo sapiens
  misc_feature: GZ8MTXP01CXF5L.15.55.E11.1.454.CMB.2.raw
  modified_base (237)..(237): a, c, t, g, unknown or other
  modified_base (279)..(279): a, c, t, g, unknown or other
  modified_base (294)..(294): a, c, t, g, unknown or other
  modified_base (345)..(345): a, c, t, g, unknown or other
  modified_base (378)..(378): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtagaaaacacatattacgcaggctcgtgaaggccncttcaccatctccagagacaattccaaacaacactactttancttacaaatgaaacngcctgcgagcccgaggaccacggcctatactactgtgcgagagatcgaacncggccccccgtgggacgtcccgttgacctacgnggggccacgggaaccctgggtccaccgtctcctaccaacctccaaccgacgggcccacgttcccggtcccttcccccgtggacccctacccctccctaccgaacgaccgaccgtacccgtccggtacgggggcccaaccggccggcccggccccggtcggggcctccggtcccgttcgggtaccgtaaaccgggtaccgttacccgttcccggaccgttaaaccgggtacgttaaccggttcgggaccgggtccgggggccgtcgggggaccgaacgggccgaaccgaagtaag

SEQ ID NO: 387679 - DNA, 642 bp, Homo sapiens
  misc_feature: GZ8MTXP01AGZIG.15.55.E11.1.454.CMB.2.raw
  modified_base (604)..(604): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttgggagtcgtgggggaggcttggtacaggccgtggggggtccctgagactctcctgtgcagcctcgaggtcttcgcctttcgctatctatcgccatcgaccgtgggtcccgccaggcctccgaggggaggggctggagtggatctcagtcttaagttaggtggggtaggtcgggtagtaggggtaacgaaaaaccacgtaaattagttaaccgcgaacgggtccttcccgggtagggaacgggggtcccctaccttcaattcccaattcccgtacccgaaaggacaactaaacttacccaaaacaactacctattttactacttaacgaaatcgaaactacgcctgacgagcccgaggaccaccgggctaactcttactgacgcgagacggacttcggaaacncgggtaaccggtggaccgttcccgtgaaccgtaacggg

SEQ ID NO: 387680 - DNA, 631 bp, Homo sapiens
  misc_feature: GZ8MTXP01A8BMA.15.55.E11.1.454.CMB.2.raw
  modified_base (215)..(215): a, c, t, g, unknown or other
  modified_base (277)..(277): a, c, t, g, unknown or other
  modified_base (283)..(283): a, c, t, g, unknown or other
  modified_base (319)..(319): a, c, t, g, unknown or other
  modified_base (324)..(324): a, c, t, g, unknown or other
  modified_base (365)..(365): a, c, t, g, unknown or other
  modified_base (605)..(605): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtctgggggaggcttggtacagccgtggggggtccctgagactctcctgtgcagcctcaggattcgcctttcgcatctatgccatgacctgggtccnccaggctcgaggggaagggctggagtggatctcagctattaggtgggaggtggtagtggtanaaaacncatatacgcaggcctccgtgaaggccgctcacatcncaganacaatccaaacaacactactttatcccttacaaatgaaacngaacctgcgacgccgaagaccacgggtcctaatacctacgtgtagacggaagagaacgtaccggaaacgtacgggcccgtaggggaccgtccccggtagaccgttacggggcggggaccgtaaccgggacccgttcggaccctacccggttcctaccctacccaaccccgtaccccaacgaaccgggcccctaacgttcccggtaccccttccccgacgtcccacccttccacgaacgcnccgaccgtcggcggggccaacgccgg

SEQ ID NO: 387681 - DNA, 582 bp, Homo sapiens
  misc_feature: GZ8MTXP01AV7OF.15.55.E11.1.454.CMB.2.raw
  modified_base (210)..(210): a, c, t, g, unknown or other
  modified_base (238)..(238): a, c, t, g, unknown or other
  modified_base (278)..(278): a, c, t, g, unknown or other
  modified_base (342)..(342): a, c, t, g, unknown or other
  modified_base (358)..(358): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacncatattacgcaggctccgtgaagggccncttcaccatctccagagacaattccaacaacacactttancttacaaatgaacagcctgcgagccgaggacacggcctatactactgtgcgagagatcgaaacncggcccccgtgggacncccgtgactaacgtggggccagggaaccctggtcaccgtctcctcacctccaccgacggcccactcgtccttcccctcggcccaccctccctaccaacgacgccgacctcgtcgggggcacgcgccggcccgtcgggctcggccgtcggtcaacgggtacttaccgtccgcgtaaccgtacgaccgttggacggtcgggctcgggcgaacgggcgcgttgtaag

SEQ ID NO: 387682 - DNA, 565 bp, Homo sapiens
  misc_feature: GZ8MTXP01BMAK4.15.55.E11.1.454.CMB.2.raw
  modified_base (210)..(210): a, c, t, g, unknown or other
  modified_base (279)..(279): a, c, t, g, unknown or other
  modified_base (342)..(342): a, c, t, g, unknown or other
  modified_base (399)..(399): a, c, t, g, unknown or other
  modified_base (558)..(558): a, c, t, g, unknown or other
  modified_base (560)..(560): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacncatattacgcaggctccgtgaagggccgcttcaccatctccagagacaattccaaacaacacactttancttcaaatgaacagcctgcgagccgaggacacggccgtatactactgtgcgagagatcgaacncggcccccgtgggacgcccgttgactaacgtggggccagggaccctggtccacgtcncctcacctcaccacggccatccggtccttcccctggccaccctcctccaagcgccaccgtcgtcggggcacgcgccggcccgtgggcctcgccgtcgggtccaacgggtccttacgtcccgcgtacgtgaccgttggacgcgggctgggcgaaggccgngngtaag

SEQ ID NO: 387683 - DNA, 972 bp, Homo sapiens
  misc_feature: GZ8MTXP01DYW0C.15.55.E11.1.454.CMB.2.raw
  modified_base (273)..(273): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgagtgcagctgttggagtcgtgggggaggcttggtacagccgtgggggtccctgagctctcctgtgcagcctcgaggtnttcgccttcgcatctatcgccagtcgacccgtcggggtcccgccgagggcccgtaccggaaaggggggaacgggggtccgttagggggtaaggttcgggtaacttccgtacgaaggtccgtttaaaggtttaaggggttagggggtaagggggtttgggggtttaacgggttaaagggggttaaaacggtaaaaaacccgtaacttaaaacgttttaaacgtttaaacccgggaccggtaaacgggggttcccgtttaccccggggttaggggaaaaccgggggtccccggttaccgtttacccgaaaccccgtaaacgtttacccttaaccccgaaagggtaaaccgaaaacccttaaaaaccctttaacccccaaaaaaacctaaaacccgttaaacccgtttaaaaccctttttttaaacctttaacccttttaaaacccgaaaaaaatttccgggtaaaaaaccctacggtaaacccccgtttggaacccggggtaaaccggaccccgggggaaaacggggaaaccccgtaaacccgggggttaccccgtttaaaacttaacccgtttaaacccggttgggttaacggacccgggttaaaagggaaacggttaaaccgtaacccgggaaaaacccgggacccgggggttacccccggggttaagggggttaaaccccgggttttaacccccgggg

SEQ ID NO: 387684 - DNA, 682 bp, Homo sapiens
  misc_feature: GZ8MTXP01DEJ8G.15.55.E11.1.454.CMB.2.raw
  modified_base (273)..(273): a, c, t, g, unknown or other
  modified_base (392)..(392): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacagccgtggggggtccctgagactctcctgtgcagcctcaggnttcgccttcgcatctatcgccatcgaccgtgggtcccgccaggcctccgagggggaaggggctgggagtggatctcagcttagttaggtgggagggttgggtaggtagggtaagaaacnctaattaagttacgacaggggcctaccggtggaacggggcctcttccacctatcctaccgaagaacgaactaaacttaccaaacaacctacttaacttttactacctttaacaaaattcggaaaccacggtacccttcggaccggaacggccccggaagggaaacccgtacccggggttacccgtttaaacttaccgttaaacgttgggttacggccggaaaggtaacgaacgttaaccggaaaaccgcgggggacccccggggttaagggggaaccgtttcccccgggg

SEQ ID NO: 387685 - DNA, 801 bp, Homo sapiens
  misc_feature: GZ8MTXP01CTA8E.15.55.E11.1.454.CMB.2.raw
tcagtctacgtagccacgaccggtgctcgatttagcactcgcacgttgggtttgggggagctctgagagaggagcccagccctgggattttcaggtgttttcatttggtgatcaggactgaacagagagaactcacatggagtttgggctgaactggtctttttcttgtggctattgtaaaaggtgtccaatgtgagtgcagctgtggagtcgtgggggaggcttggtacaggccgtggggggtccctggacgactctccgtgtgcacggcctcgaggtacttccggtcccttcgctatctatcgccctagtcggaccccgtcgggtccccgccgtagggcccgtccggaagggggaacgggggccgtaggggtaaggtcgggacttccgtacgtaggtcgttaacgttagggtggggtagggttaggggtaaggttaacggggttaaacgaaacctactaaagtttaacgtttaaccgcggaacgggtcccgtacccgggttagggaaacccggggtcccctactttacccgaaccctagttacccctacccgaaaggacccgtaaaccttaaaccttaaccccaaaactaaacccgtaaccgtttaacttttaactccctttaaacggaaaattccggaaaactcggtccctaggaacccggacgtccccggaaaggtaacccgaccgggttccgttaaacttaccgttaaccggtgttacggccggttaaggtaacgtaccgtaaccggaaaacgggcccgggggacccgtttaacgggggaaccccgttccccgggg

SEQ ID NO: 387686 - DNA, 603 bp, Homo sapiens
  misc_feature: GZ8MTXP01AN4RV.15.55.E11.1.454.CMB.2.raw
  modified_base (212)..(212): a, c, t, g, unknown or other
  modified_base (240)..(240): a, c, t, g, unknown or other
  modified_base (257)..(257): a, c, t, g, unknown or other
  modified_base (282)..(282): a, c, t, g, unknown or other
  modified_base (600)..(600): a, c, t, g, unknown or other
  modified_base (602)..(602): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaaggggctggagtggatctcagctattagtggaggtggtagtggtagaaaacncatattacgcaggctccgtgaagggccncttcaccatctccaganacaattccaaacaacactactttancttacaaatgaacagcctgcgagccgaggacacggcctatactactgtgcgagagatcgaacgcgggccccccgtggggacgtcccgttgactaacgcggggccaacggggaaccctgggccaccgtctcctacaccctccgaccgaacggcccacgtccgtcccttccccgtcggcccaccccgtcctaccgaacgcgccgaccgtcggtcgggggaccacgcggccggcccgtcgggcctccggcccggtacgaacggtcctaccgttccgcgttacgtacgacgttcggcgcgggcgtcggcgaggcgactaagngng

SEQ ID NO: 387687 - DNA, 650 bp, Homo sapiens
  misc_feature: GZ8MTXP01BXD9P.15.55.E11.1.454.CMB.2.raw
  modified_base (208)..(208): a, c, t, g, unknown or other
  modified_base (234)..(234): a, c, t, g, unknown or other
  modified_base (274)..(274): a, c, t, g, unknown or other
  modified_base (644)..(644): a, c, t, g, unknown or other
tcagtctacgtagccacgaccggtgctcgatttagcactcgcacgttgggtttggggaggcttggtacagcctggggggtccctgagactctcctgtgcagcctcaggattcgcctttcgcatctatgccatgacctgggtccgccaggctcgagggaagggctggagtggatctcagctattagtggagtgttagtggtagaaaacncatattacgcaggctcgtgaaggccncttcaccatctcagagacaattccaacaacactactttancttacaaatgaaacagcctgcgagccgagacacggcctatactactgtgcgagagatcgaacgacgggcccccgtggggacgtcccgttagaccgtaacggtcggggccgaacgggtaacccgtgggtaccacccgggttcctacccgtacccaaaccctcccgaaccgaacggggcccctaaggttcccgggttccccttcccccggtggcccctaccccgttccctacccgaaagacgcccgtaccgtcggtacgggggccaccgacggcccgggcccgttcgggggccttcggcccgtgggtccaaacgggtcttaccgttccgacgtaacggtagaccgttggacggcggaccgtggacaggccgngaagtg

SEQ ID NO: 387688 - DNA, 587 bp, Homo sapiens
  misc_feature: GZ8MTXP01DWWH2.15.55.E11.1.454.CMB.2.raw
  modified_base (363)..(363): a, c, t, g, unknown or other
  modified_base (388)..(388): a, c, t, g, unknown or other
  modified_base (539)..(539): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggaggcttggtacaggccgtgggggtccctgagactctcctgtgcagcctcgaggtacttcgtcctttcgcatctatcgccatcgaccgtgggtcccgcctaggcctccgaggggaacggggctggagtggatctcagtcttagttaggnggaggtggtaggtaggtagaaaacnctaaatacttcgcaggctccgtaggacgggcgtcttcatcatctcaagacgaactaacttaccaaacaaacactaactttactacttaacaaatacaacagccgtgcgaagccgagacgacggccgtaatccttagtgttcgacgagacgngttaccgaagacggcccgtgggaccgttcccgttaagccgtaaccggg

SEQ ID NO: 387689 - DNA, 579 bp, Homo sapiens
  misc_feature: GZ8MTXP01A12WS.15.55.E11.1.454.CMB.2.raw
  modified_base (383)..(383): a, c, t, g, unknown or other
  modified_base (389)..(389): a, c, t, g, unknown or other
  modified_base (420)..(420): a, c, t, g, unknown or other
  modified_base (495)..(495): a, c, t, g, unknown or other
  modified_base (537)..(537): a, c, t, g, unknown or other
  modified_base (541)..(541): a, c, t, g, unknown or other
  modified_base (554)..(554): a, c, t, g, unknown or other
  modified_base (563)..(563): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacaggccgtggggggtccctgagactctcctgtgcagcctcaggcttcgccttcgcatctatgccatcgaccgtgggtcccgccaggcctccgaagggggaggggcgtgggagtggatctcagtctagttaggtgggaggtggtagtagggtanaaacanatattacgcagggtctccgtaggacgggccncttacaccctatcctccaagacgactaaacttacccaaactaacacttaactttttagtttacaaaattgaaacngccctaggccgtacgccgaaggccaacggccttatacagtgngcgngagaatcggaacncgggcccgngggaaccgcccgtaag

SEQ ID NO: 387690 - DNA, 677 bp, Homo sapiens
  misc_feature: GZ8MTXP01AF0Z9.15.55.E11.1.454.CMB.2.raw
  modified_base (246)..(246): a, c, t, g, unknown or other
  modified_base (291)..(291): a, c, t, g, unknown or other
tcagtctacgtagccacgaccggtgctcgatttagcactcgcacgttgggtttgggggaggcttggtacagcctgggggggtccctgagactctcctgtgcagcctcaggattcgcctttcgcatctatgccatgacctgggtccgccaggctccgaggggaaggggctggagtggatctcagctattagtggaggtggtagtggtagaaaacacatattacgcaggctccggtaggaacgggccncttcaccatcctccagacgacaacttccaaacaacactactttancttacaaatgaacagcctgcgagccgaggaccacggcctatactacgtgtcgacgagagactacgaaacgcgggcccccggtgggacgtcccggttagaccgttaacggtcgggggcccaacggggaccctgggtacccacccgttctaccctaccaccctccaaccgaacgggcccagttcccgtcccttccccgtcggcccacccctcctaccgaagaccgaccgaccgtttcggcgggggaccaccggcggcccggcccggtcgggtctccggtcccgtacgggtcgaaaccgggtacctttacccgttccggccgttaaccgggtacgttaccgttcgggaccgggcggggtcgcgggacgaacgggccggtaacaagtaag

SEQ ID NO: 387691 - DNA, 668 bp, Homo sapiens
  misc_feature: GZ8MTXP01AFIVO.15.55.E11.1.454.CMB.2.raw
  modified_base (240)..(240): a, c, t, g, unknown or other
  modified_base (255)..(255): a, c, t, g, unknown or other
  modified_base (279)..(279): a, c, t, g, unknown or other
  modified_base (642)..(642): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaagggctggagtggatctcagctattagtggaggtggtagtggtagaaaacacatattacgcaggctccgtgaacgggccncttcacatctcaganacaattccaacaacactactttancttacaaatgaacacgcctgacgagccgaggacacggcctatactactgtgacgagagactacgaaacgcgggccccgtggggacgtcccggttagaccgtaacggtcgggggaaccacgggggtaacccctgggtacccaccgttctccctacctaaccctacccaacccgaacgggcccctacgttcccggttaccccgttcccccgtggacccctaccccgtccgtaccgaacgtaccgcccgtacccgttcgggccggggaccacggccgccgggcccgttcggggcctcggccctacgggtccgaaacgtccgttaccgttcccggacttaccggtaacgttcgttaggcggccgggntcggggacgaacggcgaacaagtaag

SEQ ID NO: 387692 - DNA, 591 bp, Homo sapiens
  misc_feature: GZ8MTXP01BC21U.15.55.E11.1.454.CMB.2.raw
  modified_base (214)..(214): a, c, t, g, unknown or other
  modified_base (286)..(286): a, c, t, g, unknown or other
  modified_base (322)..(322): a, c, t, g, unknown or other
  modified_base (387)..(387): a, c, t, g, unknown or other
  modified_base (554)..(554): a, c, t, g, unknown or other
  modified_base (570)..(570): a, c, t, g, unknown or other
  modified_base (587)..(587): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtctgggggaggcttggtacagcctggggggtccctgagactctcctgtgcagcctcaggattcgcctttcgcatctatgccatgacctgggtccncaggctccgagggaaggggctggagtggatctcagcttattaggtgggaggtggggtagtcggtagaaaacncatattacgcaagggcctccggtagaacggggcccncttccaccatccaccaagagaacaattccaaacaacactactttatcccttacaaagtgaaaccngccgtgcgacgaccgagacgacggtctaatactacgtgtgacgagagagtacgacgacggccggagggcgtccgtagacgtacggggcgggccgacggaccgtcgtccgaccgtcctcctacctaccaccaccgacggccctacgttccgtcccttcccgtcgcccncccgttccaccaagcnccgccgtcggcgggccncgcg

SEQ ID NO: 387693 - DNA, 723 bp, Homo sapiens
  misc_feature: GZ8MTXP01BIL1C.15.55.E11.1.454.CMB.2.raw
  modified_base (406)..(406): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattagtaaaaggtgtccaatgtgaggtgcagctgttggagtcgtgggggagcttggtacaggccgtgggggtcctgagactctcctgtgcagcctcgaggtacttccgtcctttcgctatctatcgccatcgaccgtcgggtcccgccgaggcctccggaaggggacgggggctagggaggtggatccgtagagtcttaagttaggtgggtagggtggtaaggtaggtaagaaaaaccncgtaaaattacgttaaccgcgtaacgggccttcccgggtagggaaccgggtcctcttacgactctactcctaccgaagaacgtaactaaaccttacccaaacctaactaacctaactttacttacgttaactaaactacgaacctacgccgtcgaccggacgacccggaacgggaccgtaccggtacccgttaacgtaaccgttaaccgtggttacggacgtaacgacggttaaaaaacgttccggaaaccgggtaccgggtaacccgggtacggggacccggttacccggttcggttaacccggttaacccggggg

SEQ ID NO: 387694 - DNA, 713 bp, Homo sapiens
  misc_feature: GZ8MTXP01CNK1T.15.55.E11.1.454.CMB.2.raw
  modified_base (283)..(283): a, c, t, g, unknown or other
  modified_base (596)..(596): a, c, t, g, unknown or other
  modified_base (662)..(662): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtaccaatgtgaggtgcagctggttggagtcggtgggggaggtcgttgggtacaggccggttggggggtcccctggagtacctctcctgtgcagcctnaggtattccgtccttcgcatctatcgccaagtcgaccgtcgggtcccgcgacggccgtaccggaaggggggaacggggcgtgggtaggtggacttctacgagtcttaaggttaggtaggggtagggtagggttaacggtaagggttaaacgaaaccgtactaagtaacgttacggcgaacggggtccctacccgggtaggaacggggccctaccttaccaacctagttacccgaccaaaggtaactaaacctaaacttacccaaaactaaactaaccttaacttttaacgtccttaaagaaagtcgaaaccgngtaaccgcggacgaccgttacgggctaaaccgcccgggttacttaacacggttaacgtgttacggnaaccggtaagaccgtaacgaaacggcgggacccggtgggaacgttccccgg

SEQ ID NO: 387695 - DNA, 753 bp, Homo sapiens
  misc_feature: GZ8MTXP01CWJUQ.15.55.E11.1.454.CMB.2.raw
  modified_base (273)..(273): a, c, t, g, unknown or other
  modified_base (278)..(278): a, c, t, g, unknown or other
  modified_base (320)..(320): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttctgtggctattgtaaaaggtgtcaatgtgaggtgcagctggttggagtcggtgggggagtcgttggtacaggccgtggggggtccctgagactctcctgtgcacgcctnaggtnttcgtccttcgcatctatcgccatcgacccgtcggggtcccnccgagggcctaccgggaagggggaacgggggctaggggaggtgggacttccgtacgaggtcgttaagtttaggggtggggtagggttggggttaaggtacgggtaaagaaacctactaagttaaacgttaccgacgaacgggtccgtacgggtacggaacggggccccttacttacccaaccgttacttaccgtacccgaagtaacgaaacctaaacttaaccccaaaactaaccttacttaacctttttaataccttaaacgaaatcggaaacctacggtccctaggacccggaacggcccggaaacgggaaccgtaacccggggttccttaaacgttacgtttaccgagggttacggaccggttaaggaaacgtacgtaacccgggaaacggacccgggggccccgggttaaggggaaccccgttcccggg

SEQ ID NO: 387696 - DNA, 539 bp, Homo sapiens
  misc_feature: GZ8MTXP01BISKE.15.55.E11.1.454.CMB.2.raw
  modified_base (346)..(346): a, c, t, g, unknown or other
  modified_base (357)..(357): a, c, t, g, unknown or other
  modified_base (379)..(379): a, c, t, g, unknown or other
  modified_base (407)..(407): a, c, t, g, unknown or other
  modified_base (499)..(500): a, c, t, g, unknown or other
  modified_base (502)..(502): a, c, t, g, unknown or other
  modified_base (529)..(529): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaaggtgtccaatgtgaggtgcagctgttggagtcgtgggggagcttggtacagccgtggggggtccctgagactctcctgtgcagcctcaggattcgccttcgcatctatgccatcgacctgggtccgccaggcctccgagggggaaggggctgggagtggatctnagctattaggnggaggtggtagtggtagaaacncatatcgcagggctaccgtgaacgggcncttcaccatctcagagacaattaccaaacaacactacttttatttacaaatcgaacagcctgcgagcccgagctaacggcttatacacgtgnngnagaatcggaacacgggcccgttgggcncccggttaag

SEQ ID NO: 387697 - DNA, 668 bp, Homo sapiens
  misc_feature: GZ8MTXP01EYR7N.15.55.E11.1.454.CMB.2.raw
  modified_base (215)..(215): a, c, t, g, unknown or other
  modified_base (316)..(316): a, c, t, g, unknown or other
  modified_base (581)..(581): a, c, t, g, unknown or other
  modified_base (635)..(635): a, c, t, g, unknown or other
  modified_base (641)..(641): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtcgtgggggaggcttggtacagcctggggggtccctgagactctcctgtgcagcctcaggattcgcctttcgcatctatgccatcgacctggtccnccaggctcgagggagggctggagtggatctcagtcttagttggtggaggttggagtggtaagaaaacctaatattacgcaggcctcggtagaacgggcccncttacacctatcctacgaagacgtaacctaaacttacccaaacgtaacctaacttaacttttactaccccttaacaaaatcgaaacacgtcctaggccgaaacgcccggaaggaacccgacccggggtactaattacctaacgtgtacgacggaagtacgacgtaacggaacgtacgggcccggtagggacccgtccggtagaccgacgggggtcggggaccgtacgggacccgtgtacccgcccgttctacccaccgtaacccnccgaacccgtaacggccctacgttccgtccccttccccgacgcccttcccttcncgaacncgaacctccggcgagggccaacgccgg

SEQ ID NO: 387698 - DNA, 719 bp, Homo sapiens
  misc_feature: GZ8MTXP01BFL1W.15.55.E11.1.454.CMB.2.raw
  modified_base (276)..(276): a, c, t, g, unknown or other
  modified_base (282)..(282): a, c, t, g, unknown or other
  modified_base (311)..(311): a, c, t, g, unknown or other
  modified_base (320)..(320): a, c, t, g, unknown or other
  modified_base (329)..(329): a, c, t, g, unknown or other
  modified_base (375)..(375): a, c, t, g, unknown or other
  modified_base (424)..(424): a, c, t, g, unknown or other
  modified_base (637)..(637): a, c, t, g, unknown or other
tcagtctacgtagccacgaccggtgctcgatttagcactcgcacgttgggtttgggctgaactggctttttcttgtggctattgtaaaaaggtgtccaatgtgaggtgcagctgttggagtctgggggagcttggtacagcctggggggtccctgagactctcctgtgcagcctcaggattcgcctttcgcatctatgccatgacctgggtcccgcaggctcgaggggaggctggagtgatctcagtcttagtaggtgggaggtggtagtaggtanaaaacnaatattacgcaggcctcggtgaacggccncttacactntctacaganactaactccaaacaacgacttactttataccctagaaatcgaaacncgtccagcgagccggaagccacggacttatactactagtcgacgacganagtaccggaacgacggcccggtagggaccgtaccgttacgaccgttacgggggaccgggggacccgtaaaccgggtaccccgtagttaccccggacccgtttaccctaaccccgtaaccaaacccccgttacccgaaaccccggtaccggggaaccccttaacttccccggggttcccctttccccccgggaggtaccccccgttaacccccncccttaacccggaaacggtcccccggtaacgttaaccccccgggtgggggaccccggggtaaccccgcccgggtaacccggg

SEQ ID NO: 387699 - DNA, 534 bp, Homo sapiens
  misc_feature: GZ8MTXP02HPHHT.15.55.E11.1.454.CMB.2.raw
tcagtctacgtagccacgaccggtgctcgatttagcactcgcacgttgggtttggggaggcttggtacagcctgggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaaacaggcccccgtgggacgcccgttgactacgtggggccaggggaaccctggtccaccgtctcctcaacctccaccaggccatcgtctcccctgcaccctcctccagacgcacctctcggggcacacgcggccctgggctgcctggtcaaggactacttccgctacgtacgactgacgcggctcggcaaggcgcatag

SEQ ID NO: 387700 - DNA, 594 bp, Homo sapiens
  misc_feature: GZ8MTXP02GPAEU.15.55.E11.1.454.CMB.2.raw
  modified_base (463)..(463): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgtttcccatcgactacgcctttcggcctcgccttagggtcgactcaccctgccccgattaacgtgacaggaacccttggtcttcggcgagcgggctttcaccgctttatcgttacttatgtcagcattcgctacttctgactacctccagcatcgcctcacagcacaccttcacagctacagaaaccnctacccctaacccaacaaccgcaataaacgcgtcgctcgcccgcagcttcggtcgcctaagttcgggtttacgcccccgttttacacgttcccttccccgcctacttcctagacggtccttaacggtaacg

SEQ ID NO: 387701 - DNA, 538 bp, Homo sapiens
  misc_feature: GZ8MTXP02HW6VV.15.55.E11.1.454.CMB.2.raw
  modified_base (400)..(400): a, c, t, g, unknown or other
  modified_base (432)..(432): a, c, t, g, unknown or other
  modified_base (435)..(435): a, c, t, g, unknown or other
  modified_base (437)..(437): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccccgtggggacgcccgttgactacgtggggccaggggaaccctggtccaccgtcncctcacctccacacgccatcgtctcccctgcnccncncagcgcacctcgtcggggcacgacgcgccgtggctcgccgtcgtcaacggactactccgctacgtacgacgtgacgcgggcgtcggcgaaggcgcgagtag

SEQ ID NO: 387702 - DNA, 582 bp, Homo sapiens
  misc_feature: GZ8MTXP02JK1FG.15.55.E11.1.454.CMB.2.raw
  modified_base (342)..(342): a, c, t, g, unknown or other
  modified_base (376)..(376): a, c, t, g, unknown or other
  modified_base (405)..(405): a, c, t, g, unknown or other
  modified_base (518)..(518): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggcttttcttgtggctattgtaaaaggtgtccaatgtgaggtgcagctgttggagtcgtgggggaggcttggtacagccgtggggggtccctggagactctcctgtgcagcctcaggattcgcctttcgcatctatgcccatcgaccgtcgggtccgccaggcctccgaggggaaggggctggagtggatctnagctattaggtggaggtggtagtggtagaaaacnatatacgcaggcctccgtagaacgggccncttaccaccctatccgtacccagacgaacaacttacccaaaacaaccactacttttaataccttacaaaatcgaaacacgcctagcgacgcgaaggacacggctaatactacngtcgacgagacgactacgaacgcggccccggtagggaccgtcccgtagaccgtacgtccggggg

SEQ ID NO: 387703 - DNA, 560 bp, Homo sapiens
  misc_feature: GZ8MTXP02GZZBS.15.55.E11.1.454.CMB.2.raw
  modified_base (373)..(373): a, c, t, g, unknown or other
  modified_base (377)..(377): a, c, t, g, unknown or other
  modified_base (399)..(399): a, c, t, g, unknown or other
  modified_base (404)..(404): a, c, t, g, unknown or other
  modified_base (427)..(427): a, c, t, g, unknown or other
  modified_base (445)..(445): a, c, t, g, unknown or other
  modified_base (452)..(452): a, c, t, g, unknown or other
  modified_base (481)..(481): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgccttcggcctcgccttagggtcgactcaccctgccccgattaacgtgacagaacctggtctcggcgagcgggctttcgaccgnttancgttacttatgtcagcattcgncttcngatacctccagcatcgctcacancacacctcacagctacanaacgacnccctacccaacaacacacaacacgcgccncgccgcacgcgtcgtcgcgtacgtcgttacgtcccgttcctactcctcccgtccctactctcgtacgtacgtacgtacg

SEQ ID NO: 387704 - DNA, 546 bp, Homo sapiens
  misc_feature: GZ8MTXP02HHQK5.15.55.E11.1.454.CMB.2.raw
  modified_base (301)..(301): a, c, t, g, unknown or other
  modified_base (334)..(334): a, c, t, g, unknown or other
  modified_base (343)..(343): a, c, t, g, unknown or other
  modified_base (392)..(392): a, c, t, g, unknown or other
  modified_base (402)..(402): a, c, t, g, unknown or other
  modified_base (418)..(418): a, c, t, g, unknown or other
  modified_base (430)..(430): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacagccgtgggggtccctgagactctcctgtgcagcctcaggattcgcctttcgcatctatgccatgacctgggtccnccaggctccgagggaagggctggagtggatctnagctattgnggaggtggtagtggtagaaaaccatatcgcaggctccgtgaacgggccncttcacatcnccagagacatccaaanaacacactttancttacaaagttgaacagcctagccgagcccgaggtacacggccgtatactacgtgtcgacgaagagactccgaaacaacggccccgtagggactccccgtgaccgttacgcggggg

SEQ ID NO: 387705 - DNA, 562 bp, Homo sapiens
  misc_feature: GZ8MTXP02GQ3AZ.15.55.E11.1.454.CMB.2.raw
  modified_base (280)..(280): a, c, t, g, unknown or other
  modified_base (348)..(348): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtctgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacanatattacgcaggctccgtgaagggccgcttcaccatctccagagacaattccaaacaacacactttanccttcaaaatgaacagcctgcgagccgaggacacggcgtatactactgtgcgagagatacgaacaggcccgtgggacgcccgttgactacgtggggaccagggaaccctggtccaccgtcctcctccaacctccacccgaaacgggcccacgtccggtcccttcccccgtggcccaccctccacccaacgacgccacctcgcggggccacgcgg

SEQ ID NO: 387706 - DNA, 541 bp, Homo sapiens
  misc_feature: GZ8MTXP02IO7II.15.55.E11.1.454.CMB.2.raw
  modified_base (341)..(341): a, c, t, g, unknown or other
  modified_base (363)..(363): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtctgggggaggcttggtacagcctgggggtccctgagactctcctgtgcagcctcaggattcgcctttcgcatctatgccatgacctgggtccaccaggctccgagggagggctggagtggatctcagctattagnggaggtggtagtgtagaaaacncatatcgcaggctccgtgaagggccgcttcacatcaccagacgacaacttccaaacaacacactttaatactttacaaatgaacagaccctgcgagccgaggacacggcgtatacactgtcgcgagacgactcgaacgaacggcccggagggacgccgttacgacgtacggtacgggg

SEQ ID NO: 387707 - DNA, 634 bp, Homo sapiens
  misc_feature: GZ8MTXP02G6JJ0.15.55.E11.1.454.CMB.2.raw
  modified_base (210)..(210): a, c, t, g, unknown or other
  modified_base (237)..(237): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacncatattacgcaggctccgtgaaggccncttcaccatcctccagagacaattccaacaacacactttatcttcaaatgaacagcctgcgagccgaggacacggcctatactactgtgcgagagatcgaaacacggcccccgtggggacgtccccgttagaccgtacgtggggcccaacggggaacccctgggtacccacccgttcctccctaccaaaccctcccgaaacccgaacggggaccccacgtcccggttcccttccccccgtcgggccctaccccctcccgtacccaaacgaccgcccacccgtcgtcgggggccaccgacggccggcccgtcgggcctcgccgtggtaccaacggactaccgtccgacgtacgtacgaccgtgacggccggacgtcggaccgaaggccgacgacgtag

SEQ ID NO: 387708 - DNA, 546 bp, Homo sapiens
  misc_feature: GZ8MTXP02FQVR9.15.55.E11.1.454.CMB.2.raw
  modified_base (299)..(299): a, c, t, g, unknown or other
  modified_base (365)..(365): a, c, t, g, unknown or other
  modified_base (401)..(401): a, c, t, g, unknown or other
  modified_base (428)..(428): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtctgggggaggcttggtacagcctgggggtccctgagactctcctgtgcagcctcaggattcgcctttcgcatctatgccatgacctgggtccnccaggctccgagggaggggctggagtggatctcagtctataggtggaggtggtagtgtagaaaacnatatcgcaggctccgtgaacgggccgcttcacatcncagagacattccaacacactactttancttacaaatgaacagcctgcgagccgaggaccacggcgtaatactacgtgtacgcgaagacgactaccgaaacgaacgggcccgtagggacgtcccggttagaccgttacgccggggg

SEQ ID NO: 387709 - DNA, 608 bp, Homo sapiens
  misc_feature: GZ8MTXP02G5B0K.15.55.E11.1.454.CMB.2.raw
  modified_base (491)..(491): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacagccgtggggggtccctgagactctcctgtgcagcctcaggatccgcctttcgcatctatgccatcgaccgtgggtcccgccgaggcctaccgaggggaaggggctgggagtggatctcagctagttagtggaggtggtaggtggtagaaacacaatagtacgcaggctccgtagaacggcccgcttacaccatcctacccaagaacgacaaattacccaaaacaaccaactaacttttaatcttaacaaaatcgaaacncgaccctgaccgaagcccggaaacggaccgaaccgggtaccttaaactaacctaacgtcgtagaccgaagaagtacaccggaaacgaccgggacccggtacggggaccgtaccccgg

SEQ ID NO: 387710 - DNA, 533 bp, Homo sapiens
  misc_feature: GZ8MTXP02GS3OX.15.55.E11.1.454.CMB.2.raw
  modified_base (353)..(353): a, c, t, g, unknown or other
  modified_base (374)..(374): a, c, t, g, unknown or other
  modified_base (444)..(444): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtctgggggaggcttggtacagccgtggggggtccctgagactctcctgtgcagcctcaggattcgcctttcgcatctatgccatgacctgggtccgccaggcctccgagggaaggggctgggagtggatctcagctagtagnggaggtggtagtggtagaacncatatacgcaggctccgtgaagggccgcttcaccatctaccagagacaactccaaacaacactactttancttacaaatcgaacagcctagcgagccgagaccacggcctatacactgtcgcgagaagactacgaacgacggcccgtggggactcccgg

SEQ ID NO: 387711 - DNA, 767 bp, Homo sapiens
  misc_feature: GZ8MTXP02HLVJX.15.55.E11.1.454.CMB.2.raw
  modified_base (302)..(302): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggagcttggtacaggccgtgggggtccctgagactctctgtgcagcctcaggcttcgcctttcgcatctatgccatcgaccgtgggtccnccgaggcctaccgaggggaacgggctgggagtggatctacgagtctagttaggtgggaggttcgggtagtggttaaggaaaaactactaagttacgttacggctaacggggtccttcccggtagggaacgggggcccctacgttacccaccctaatccctaccgaagaacgaaacctaaacttacccaaaactaaccaacctacgtttttaaatacctttaacgaaaactttacggaaacctacggtacccttacggaccggaaacgggaccccgggaaacgggtaacccgaacccgggggtacccccgtttaaaattaaccggttaaacccggttggttaacccggacgggtaaagaacggtaaccgttaacccggaaaaaccgtaaccgggggtcccccgggtacgggggtaaacccggttcccccggttacggtaaccggtttaccgggtaaccccgggggg

SEQ ID NO: 387712 - DNA, 713 bp, Homo sapiens
  misc_feature: GZ8MTXP02HH0T0.15.55.E11.1.454.CMB.2.raw
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggcttttcttgtggctattgtaaaaggtgtccaatgtgaggtgcagctgttggagtctgggggaggcttggtacagccgtggggggtccctgagactctcctgtgcagcctcaggattcgcctttcgcatctatcgccatcgacctgggccgccaggcctccgaggggaaggggctgggagtggatcgtcagcttagttaggtgggtagggtgggttaggtggggttaacgaaacgactaattaacttacgccaaggggtccttcccgggtagggaaacgggggccccgtactttacccaacccgtattacccgtacccgaaggaacgtaacctaaaaccttaccccaaaacaaaccctaaccttaaccttttttaacaccgtttaaaccaaaagttacgaaacccgacgtcccgttagacccggaacggaccccggaagggaacccgaccgggtacccgtttaaactaaccggtaacttcgggagacccggaaaggaacggaacttacggggaaaacccgtcgggggacccccggttagggggaacccgtccccggg

SEQ ID NO: 387713 - DNA, 559 bp, Homo sapiens
  misc_feature: GZ8MTXP02IHK2M.15.55.E11.1.454.CMB.2.raw
  modified_base (342)..(342): a, c, t, g, unknown or other
  modified_base (371)..(371): a, c, t, g, unknown or other
  modified_base (544)..(544): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttacaaatgaacagcctgcgagccgaggacacggccgtatactactgtgcgagagatcgaacnggcccccgtgggacgcccgttgactacgnggggccagggaaccctgggtccacccgtctcctcaaccctccaccaacggcccatccggtccttccccctggccacccctcctccaacgacgccacccgtcgtcgggggcacgacgccggccctgggctgcctggtcaacggactactccgctacgtacgactgacggcggcncggcaggcgacatag

SEQ ID NO: 387714 - DNA, 540 bp, Homo sapiens
  misc_feature: GZ8MTXP02JXYZU.15.55.E11.1.454.CMB.2.raw
  modified_base (372)..(372): a, c, t, g, unknown or other
  modified_base (383)..(383): a, c, t, g, unknown or other
  modified_base (448)..(448): a, c, t, g, unknown or other
  modified_base (496)..(496): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggcttttcttgtggctattgtaaaaggtgtccaatgtgaggtgcagctgttggagtcgtgggggaggcttggtacagccgtggggggtccctgagactctcctgtgcagcctcaggattcgcctttcgcatctatgccatgacctgggtccgccaggctccgagggaaggggctgggagtggatctcagctatagtggaggtggtagtggtagaacncaatattacgnaggctccgtgaacgggccgcttcgacctatctccagacgacaacttccaaacaacactactttanacttacaaatgaaactgacctgcgagccgagacacggcctatactacngtacgacgagaagactacgaacgaggcccggtaggactacccgg

SEQ ID NO: 387715 - DNA, 672 bp, Homo sapiens
  misc_feature: GZ8MTXP02H72K3.15.55.E11.1.454.CMB.2.raw
  modified_base (280)..(280): a, c, t, g, unknown or other
  modified_base (427)..(427): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtctgggggaggcttggtacagcctggggggtccctgagactctcctgtgcagcctcaggattcgcctttcgcatctatgccatgacctgggtccgccaggctccgagggaaggggctggagtggatctcagctattagtggaggtggtagtggtgaaaacncatattacgcaggctccgtgaagggcccgcttcaccatctccagagacaaattccaaacaacactactttatcctacaaatgaacagcctgcgagccgaggaccacggccgtatactactgtgcgagagatcgaaacaggccccggnggggacgcccgttagaccgttaccggtgggggtacccaaggggaacccccgtggtacccgaacccggtccttaccccgtaccgaaaccccttcccgaaccccgaaaacggggccccctaacgttccccggggtaccctttccccccccgtacgggtccccctaccccccgttcccgttacccccaaacggacccgaccccgtaacccgtacccggttccggggggacccaaacccggacccgggg

SEQ ID NO: 387716 - DNA, 584 bp, Homo sapiens
  misc_feature: GZ8MTXP02I58NL.15.55.E11.1.454.CMB.2.raw
  modified_base (270)..(270): a, c, t, g, unknown or other
  modified_base (345)..(345): a, c, t, g, unknown or other
  modified_base (554)..(554): a, c, t, g, unknown or other
  modified_base (561)..(561): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacaggccgtggggggtccctgagactctcctgtgcagcctnaggattcgcctttcgcatctatcgccatgaccgtggtccgccaggctccgaggggaggggctgggagtggatctnagcttagtagtggaggtggtagtggtagaacgcatatacgcagggctccggtagaacgggtccctcgttccaacctatcctaccagaacgaacctaacttacccaaaactaaacctaacctaaactttttactacctttacaaaagtcgaaactagccctgacgacgcggacgacacgggcctatactacgtgtacgacgtagaacganacgaacncgggcccggtaggacgtacccgg

SEQ ID NO: 387717 - DNA, 542 bp, Homo sapiens
  misc_feature: GZ8MTXP02I01JK.15.55.E11.1.454.CMB.2.raw
  modified_base (351)..(351): a, c, t, g, unknown or other
  modified_base (374)..(374): a, c, t, g, unknown or other
  modified_base (389)..(389): a, c, t, g, unknown or other
  modified_base (399)..(399): a, c, t, g, unknown or other
  modified_base (408)..(408): a, c, t, g, unknown or other
  modified_base (438)..(438): a, c, t, g, unknown or other
  modified_base (451)..(451): a, c, t, g, unknown or other
  modified_base (513)..(513): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacagccgtgggggtccctgagactctcctgtgcagcctcaggattcgcctttcgcatctatgccatcgacctgggtcccgccaggcctccgaggggaaggggctgggagtggatctcagctagttagnggaggtggtagtggtagaaaacnatatcgcaggctcgngaagggccgnttcacctanctacagagacataccaacaacacactttancttacaatgaacngctgcagcgagacacgcgtatacatcgtgacgaagtagacgtaccgaacgaacggaccccgngggaccgtcccgtagacgttaacgcgggg

SEQ ID NO: 387718 - DNA, 581 bp, Homo sapiens
  misc_feature: GZ8MTXP02FKRWL.15.55.E11.1.454.CMB.2.raw
  modified_base (416)..(416): a, c, t, g, unknown or other
  modified_base (513)..(513): a, c, t, g, unknown or other
  modified_base (523)..(523): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgttgacaggaacccttggtcttccggcgagcgggcttttcgacccgctttatcgttacttatgtcagcattcgctcttcngtatacctcagcatcgcctcacagcacaccttcacaggccttacacgtaaaccgcctaccccctacccaacaaccgacataaacgctcgctcgccgnacgcttcggngcgtactggtttacgccccgtttcacttcctcccgctactcctgacgtcgtacgtacg

SEQ ID NO: 387719 - DNA, 735 bp, Homo sapiens
  misc_feature: GZ8MTXP02FY7O1.15.55.E11.1.454.CMB.2.raw
  modified_base (339)..(339): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggcttttcttgtggctattgtaaaaggtgtccaatgtgaggtgcagctgttggagtcgtgggggaggcttggtacagccgtggggggtccctgagactctcctgtgcagcctcaggattcgcctttcgcatctatgccatgacctggtccgccaggctccgaggggagggctgggagtggatcncagctattagtggaggtggtagtaggtaagaaacacaatagttacgcgaagggtcctccggtaggaaacggggccctacgttaccgaaccctaagttccctaccgaaggaaacgtaaccctaaaactttaccccaaaaactaaaccctaaaccttaaccgtttttaactaccctttttaaaccgaaaaattaaccgaaaaccgtacggtacccccgttaaggacccgggtaaacgggacccccggaaacgggggaaacccgtaaacccggggtaccccggtttaaaactaaacccgtttaaaccgttagggtaccggacccggaaaaggtaacggaacttaccgggaaaaaccgacgggggtaccccccggttagggggaaccgttacccccgggg

SEQ ID NO: 387720 - DNA, 577 bp, Homo sapiens
  misc_feature: GZ8MTXP02FWNB0.15.55.E11.1.454.CMB.2.raw
  modified_base (343)..(343): a, c, t, g, unknown or other
  modified_base (577)..(577): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacacatattacgcaggctccgtgaagggccgcttcaccatctccagagacaattccaaacaacacactttatcttacaaatgaacagcctgcgagccgaggacacggcctatactactgtgcgagagatcgaaacnggcccccgtgggacgcccgttagactacgtggggccaggggaaccctgggtccaccgttctccctcaaccctccaacccaacgggcccactccggtcccttccccctggcccacccctcctccaaacgacgccaccctcgtcggggccacgacgcggcccgtgggctgccctggaccaacggactacgttccgtagtacgacgtcgaggcgggctggacaacggcacgagtagn

SEQ ID NO: 387721 - DNA, 617 bp, Homo sapiens
  misc_feature: GZ8MTXP02HO2O9.15.55.E11.1.454.CMB.2.raw
  modified_base (413)..(413): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgtttcccatcgactacgcctttcggcctcgccttaggggcactcaccctgccccgattaacgttggacaggacccttggtcttccggcgagcgggtctttcgacccgtctttatcgttacttactgtcagcattcgcncttctgatacctccagcatgcctcacagcacaccttcacaggccttacagaaccgccttacccccaacccaacaacgcaataaacgccgtcgctcgcccgctacggccttcggtcgacgtaacgttcgggttttaaccgcccccgttttcaaccgttcctttaacccccgcctaacttccctaggacgtaccttaaccggtacg

SEQ ID NO: 387722 - DNA, 547 bp, Homo sapiens
  misc_feature: GZ8MTXP02HW7ZT.15.55.E11.1.454.CMB.2.raw
  modified_base (378)..(378): a, c, t, g, unknown or other
  modified_base (387)..(387): a, c, t, g, unknown or other
  modified_base (396)..(396): a, c, t, g, unknown or other
  modified_base (406)..(406): a, c, t, g, unknown or other
  modified_base (433)..(433): a, c, t, g, unknown or other
  modified_base (447)..(447): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacaggccgtggggggtccctgagactctcctgtgcagccctcaggattcgcctttcgcatctatgccatgacctgggtccgccaggctccgaggggaaggggctgggagtggatctcagctagttagtggaggtggtagtggagaaacnatattacgnaggctccgngaagggcccnttcacatctccagagacaattccaaanaacactacttttancttacgaaatgaacagcctgcgagccgaaggacacgggtcctaatactactggtacgcgaagaagacgtaccgaaacgcggaccccgtggggactcccgg

SEQ ID NO: 387723 - DNA, 600 bp, Homo sapiens
  misc_feature: GZ8MTXP02GZJI7.15.55.E11.1.454.CMB.2.raw
  modified_base (376)..(376): a, c, t, g, unknown or other
  modified_base (404)..(404): a, c, t, g, unknown or other
  modified_base (409)..(409): a, c, t, g, unknown or other
  modified_base (427)..(427): a, c, t, g, unknown or other
  modified_base (505)..(505): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatagccttctccgtccccccttcgcagtaacaccaagtacaaggaatattaacctgtttcccatcgactacgccttcggcctcgccttaggggcactcaccctgccccgataacgtgacaggaaccctggtctcggcgagcggtctttcaccgtntttatcgttactatgtcagctattcgcncttcngactacctccagccatcncctcacacgcacaccttcacaggcttacacgaaaccgcctacccctaacccaaacaacacaactaaacgcgtcgtccncgccgactacgtccgttcggtcactacgttcggtttaccgtccccgttctaccgttccctcccgcctactcgtacgtacgtaccgtaacggtacg

SEQ ID NO: 387724 - DNA, 624 bp, Homo sapiens
  misc_feature: GZ8MTXP02HDSGF.15.55.E11.1.454.CMB.2.raw
  modified_base (237)..(237): a, c, t, g, unknown or other
  modified_base (246)..(246): a, c, t, g, unknown or other
  modified_base (275)..(275): a, c, t, g, unknown or other
  modified_base (622)..(622): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtagaaaacacatatacgcaggctccgtgaaggccnctcacatcncagagacaattccaacaacactactttancttacaaatgaacagcctgcgagccgaggacacggcctatactactgtgcgagagatacgaacgacggcccccgtaggggactcccgttagaccgtacgtcggggcccaacggggaacccttgggtaccaccgttcctcccgtacccaaaccctccaacccgaacgggcccctacgtcccggtacccttcccccgtcggcccaccccctcctaccgaaacgacgccacccgttcggtcgggggaccaccgacggcccgggcctcggggctcgccgtcggaccgaacggtcctaccttcccgacgtacgtacgactggacggcgggcgtacgggacaacgggcacganag

SEQ ID NO: 387725 - DNA, 580 bp, Homo sapiens
  misc_feature: GZ8MTXP02H3Q8T.15.55.E11.1.454.CMB.2.raw
  modified_base (304)..(304): a, c, t, g, unknown or other
  modified_base (347)..(347): a, c, t, g, unknown or other
  modified_base (363)..(363): a, c, t, g, unknown or other
  modified_base (368)..(368): a, c, t, g, unknown or other
  modified_base (375)..(375): a, c, t, g, unknown or other
  modified_base (382)..(382): a, c, t, g, unknown or other
  modified_base (389)..(389): a, c, t, g, unknown or other
  modified_base (451)..(451): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtcttttttcttgtggctattagtaaaaggtgtccaatgtgaggtgcagctgttggagtcgtgggggagcttggtacaggccgtgggggtccctggagactctcctgtgcagcctcaggattcgcctttcgcatctatgccatgacctgggccnccaggcctccgagggaaggctggagtggatctcagctattggnggagtggtagtggtanaaacnatatcgnagctcgngaggccntcacatcacagacgacaacttccaaacaaccactaactttatcttacaaaagttgaaaaccncgacgtagacgacgaccggacgaaccgtaccggacctaatacctacgtggacgacggaagaacgacgtacgaacggaaccgggacccggtacggggacccgtacccgttacgaaccgtacggaccgggg

SEQ ID NO: 387726 - DNA, 678 bp, Homo sapiens
  misc_feature: GZ8MTXP02G94HI.15.55.E11.1.454.CMB.2.raw
  modified_base (214)..(214): a, c, t, g, unknown or other
  modified_base (258)..(258): a, c, t, g, unknown or other
  modified_base (281)..(281): a, c, t, g, unknown or other
  modified_base (307)..(307): a, c, t, g, unknown or other
  modified_base (314)..(314): a, c, t, g, unknown or other
  modified_base (323)..(323): a, c, t, g, unknown or other
  modified_base (346)..(346): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtctgggggaggcttggtacagcctggggggtccctgagactctcctgtgcagcctcaggattcgcctttcgcatctatgccatgacctgggtccnccaggctccgagggaaggggctggagtggatctcagctattagnggaggtggtagtggtagaaaacncatatacgcaggctccgtgaaggccncttcacntctccaganacaatccaaacaacacactttanccttacaaatgaacacgcctgcgacgccgaggaccacggccgtatacctactgtgacgagagagtacgaaccagggccccgtaggggaccgccccggttagaccgtaccggtcgggggacccgtacggggaaccccgttgggtaccccgaacccggttcctaccccctaacccgtaaacccgttaccccgaaacccggaaaaccgggtcccccaacggttcccgggttcccccttacccccgtcgggtaccccgtacccccttaccccgtacccgaaacgtacccgaccctaacccgtttcccggacggggggaccctaaccggccccgggg

SEQ ID NO: 387727 - DNA, 701 bp, Homo sapiens
  misc_feature: GZ8MTXP02IZOSE.15.55.E11.1.454.CMB.2.raw
  modified_base (359)..(359): a, c, t, g, unknown or other
  modified_base (554)..(554): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtcttttcttgtggctattgtaaaaggtgtccaatgtgaggtgcagctgtggagtcgtgggggaggtcgttggtacaggccggtggggggtccctggagactcctcctgtgcagccctcgaggtacttccgcctttcgctatctatcgccagtcgaccgtcggccgccgaggcctaccggaggggagggctgggagtgactcncagtctagtgtgggtaggttggtaggtaggtaacgaaacactaagttaacgtaccgacgacgggtcctccggggtagggaaccgggtcccttaccttacccgaacctacgttacccacccgaaaggaacctaaacctaaaccttacccaaaaaccgaaacccttacccttaaactttttaactacccgtttaaanaaaacgttacaaaacgcgtacccgaggccgaacggcccgggaaacggaacccggtacccggacgtttaacctaactacggtcgtacgcggaaagaacgacgtaaaccggaaacgccgggaccccggtaggggacccgttaccccggg

SEQ ID NO: 387728 - DNA, 584 bp, Homo sapiens
  misc_feature: GZ8MTXP02FTEPD.15.55.E11.1.454.CMB.2.raw
  modified_base (358)..(358): a, c, t, g, unknown or other
  modified_base (386)..(386): a, c, t, g, unknown or other
  modified_base (500)..(500): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtcaatgtgaggtgcagctgttggagtcgtgggggaggcttggtacaggccgtggggggtccctgagactctcctgtgcagcctcaggattccgcctttcgcatctatcgccatcgaccgtgggtcccgccgaggcctccgaggggaaggggctgggagtggatcgtcagttntaggtggaggtggtagtggtagaaaacncatagttacgcgagggctccggtagaacgggggccctacttcgaccaatcctacccgagaacgaactacttaacccaaacaaactactaactttatccttacgaaatgaaaccngcctagacgacgacgacgaccgacgtactaatctacgtgacgacgagagaagacgaacgccggtccggtacggacgtaccgtag

SEQ ID NO: 387729 - DNA, 690 bp, Homo sapiens
  misc_feature: GZ8MTXP02H8KLJ.15.55.E11.1.454.CMB.2.raw
  modified_base (235)..(235): a, c, t, g, unknown or other
tcagtctacgtagccacgaccggtgctcgatttagcactcgcacgttgggtttgggggaggcttggtacagcctgggggtccctgagactctcctgtgcagcctcaggattcgcctttcgcatctatgccatgacctggtccgccaggctccagggaaggggctggagtggatctcagctattagtggaggtgttagtggtgaaaacacatattacgcaggctccgtgaaggccncttcaccatctccagagacaattcccaaacaacacactttatcttacaaatgaacagcctgcgagccgaggacacggccgtatactactgtgcgagagatccgaaacagggccccccgtggggacgtccccgttgacctaccggtggggcccaaggggaacccccttgggtaccaccccggttctacccctaccaaacccctacccaacccgaaacggggcccccaaccgttcccggttcccgttcccccccgtggaccccacccccgtccctacccaaacgacgaccacccgtcgtcgggggaccaccgacggccggcccgtcggggccgtcggtcccgtcgggtaccgaaaacggggtaccttaacccgtttcccggtaccgttaaccggttacgtaaccgttcggacgggccggggtaccgtcgggaccgaaacggggccgaccgacgtaag

SEQ ID NO: 387730 - DNA, 645 bp, Homo sapiens
  misc_feature: GZ8MTXP02HIT8X.15.55.E11.1.454.CMB.2.raw
  modified_base (308)..(308): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacagccgtgggggtccctgagactctcctgtgcagcctcaggtacttcgcctttcgctatctatcgccatcgaccgtgggtcccnccgaggcctaccggaggggaacggggctgggagtgggactctcgagcttagttaggtgggtaggtcggtagtggtaagaaaacatatagtcgcaggctccgtagaacgggccgtcttccaacctactcctaccgagaacgaacctaacttaccccaaaactaaacctaccttaacttttaactaccgtttaaaccaaaagtttacgaaaccgacgtaccctaggccgaacggacccgtagggaaccctaccggggacccttaatacctacgtgacgacgaagacgactacgaaacgcggcccggtaggacgtcccggttagaccgttacgccggggg

SEQ ID NO: 387731 - DNA, 560 bp, Homo sapiens
  misc_feature: GZ8MTXP02HRZ2R.15.55.E11.1.454.CMB.2.raw
  modified_base (380)..(380): a, c, t, g, unknown or other
  modified_base (449)..(449): a, c, t, g, unknown or other
  modified_base (468)..(468): a, c, t, g, unknown or other
  modified_base (510)..(510): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggaggcttggtacagccgtgggggtccctgagactctcctgtgcagcctcaggattcgcctttcgcatctatgccatcgaccgtgggtccgccgaggcctccgaggggaaggggctgggagtgatctcagtctagtagtggaggtggtagtggtagaacanattatacgcgaggctcccggtagaacgggcctacttcgacctatcctacccagacgacattacccaaanaccactactttatacttanaaatcgacagcctgcgagccgaagcgacgtctactactacgngtcgacgagaagacgtaaccgacgacgggtccccggtagggacgtcccgg

SEQ ID NO: 387732 - DNA, 656 bp, Homo sapiens
  misc_feature: GZ8MTXP02HGBG5.15.55.E11.1.454.CMB.2.raw
  modified_base (266)..(266): a, c, t, g, unknown or other
  modified_base (346)..(346): a, c, t, g, unknown or other
  modified_base (512)..(512): a, c, t, g, unknown or other
  modified_base (539)..(539): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggagcttggtacagccgtgggggtcctgagactctctgtgcacgcctnaggtattcgcctttcgcatctatcgccatcgaccgtgggtccgccaggcctaccggaggggaggggctgggagtggatcncgagtcttaagttaggtgggtaggtagggttaggtggtaacgaaacacgtaattacgttacgcgaggtccttaccgggtaggaacggggccctacttccaacctacttccacccgaaggacgaaactaccttaacccaaaactaaacctaaaccttactttttaanaccgtttaacaaaattcggaaaacccncgtaccgtacggaccggacgaccggtaacggaaccgtaccggtacgtaactaccgttacgtcgacgacgaagaacgaacgaaccggacggaccggtccggtacgggtaccgtcccgg

SEQ ID NO: 387733 - DNA, 379 bp, Homo sapiens
  misc_feature: GZ8MTXP02HPR03.15.55.E11.1.454.CMB.2.raw
  modified_base (376)..(379): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaaagtacaggaatattaacctgtttcccatcgactacgcctttcggcctcgccttaggggtcactcacctgcccgattacgtgacagaccctggtctcgcgagcgggctggcagcgcatagnnnn

SEQ ID NO: 387734 - DNA, 620 bp, Homo sapiens
  misc_feature: GZ8MTXP02GNERS.15.55.E11.1.454.CMB.2.raw
  modified_base (240)..(240): a, c, t, g, unknown or other
  modified_base (283)..(283): a, c, t, g, unknown or other
  modified_base (377)..(377): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaaggggctggagtggatctcagctattagtggaggtggtagtggtagaaaacacatattacgcaggctccgtgaagggccncttcaccatctccagagacaattcccaaacaacactactttancttacaaatgaacagcctgcgagccgaggacacggctatactactgtgcgagagatacgaacgcggcccccgtggggactcccgtagactacgnggggccaggggaccctggccaccgtctccaccacctccaccgacggccactccggtcctcccccgtggcccaccctcctaccgaaagcgccaccgtcgtcgggggaccaccgacggccggcccgtgggtccgtcggtcccgtacgggaccgtaaacggtacccgttaccgttcccggaccgttaacggtacgtaccgtagggacggccggggtcgtacgggaccgaagggccgacgagtacgg

SEQ ID NO: 387735 - DNA, 745 bp, Homo sapiens
  misc_feature: GZ8MTXP02GVPTR.15.55.E11.1.454.CMB.2.raw
  modified_base (592)..(592): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtcaatgtgaggtgcagctgttggagtcgtgggggaggcttggtacaggccgtggggggtccctgacgactctcctgtgcagcctcgaggtattccgcctttcgctatctatcgccagtcgaccgtcgggtcccgaccgacggtcctacccggaagggggaacggggtccgtaggggaggtaggacttccgtcaaggtccttaagttaggtgggtaggggttagggtaggttacggggttaaagaaaaccgtactaaagttaacgttaccgacgaacggggtccttacccgggtagggtaaacggggcccccgtactttaccaaccctagttaccctacccgaaagaacgtaacctaaacttacccaaaaactaacctaaccgttaactttttaacaccctttaaaanaaaacgtacgaaacacgtccgtaggaccggacgaccgggaacggtaaccgtaccgggtaaccttaacgtaacgtacgtacggtacgacggtaagtaacgtaccgtaaaccgggaaccggacccggggtaccgggtacggggtacccgtcccgg

SEQ ID NO: 387736 - DNA, 591 bp, Homo sapiens
  misc_feature: GZ8MTXP02ISD67.15.55.E11.1.454.CMB.2.raw
  modified_base (239)..(239): a, c, t, g, unknown or other
  modified_base (341)..(341): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaaggggctggagtggatctcagctattagtggaggtgttagtggtagaaaacacatattacgcaggctccgtgagggccnttcacatctcagagacaattccaacaacactactttatcttacaaatgaacagcctgcgagccgaggacacggcgtatactactgtgcgagagatcgaaacnggcccccgtgggctcccgttgactacgcggggccagggaccctggtccaccgtctcctacaaccctccaccgacggcccacgtcccgtccttcccccgtcggccctaccctcctaccaacgacgaccaccctcgtcggggccaccgacgccggcccgtcggcgtcgtacccgtggtaccgaacggtacctaccgttccgtacgtaacgtacgacgtcggacggcgggcgtcgggacaaggccgcgagtag

SEQ ID NO: 387737 - DNA, 562 bp, Homo sapiens
  misc_feature: GZ8MTXP02I3T01.15.55.E11.1.454.CMB.2.raw
  modified_base (268)..(268): a, c, t, g, unknown or other
  modified_base (385)..(385): a, c, t, g, unknown or other
  modified_base (389)..(389): a, c, t, g, unknown or other
  modified_base (416)..(416): a, c, t, g, unknown or other
  modified_base (423)..(423): a, c, t, g, unknown or other
  modified_base (426)..(426): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacagccgtgggggtccctgagactctcctgtgcagcctnaggacttccgcctttcgcatctatcgccatcgaccgtgggtcccgccgaggcctaccggaggggaaggggctagggagtggatctcagtctagttagtgggaggtggtagtggtaanaacncatactacgcgagctcggagacggccnctcactntcncaagacacaactccaaacactactactttagcttacaaatcgaacagcctagacgagccgagaccacggactaactactacgtgtacgacgaagaagtacgtacgaaacgcggaccccggtagggaccgtacccgg

SEQ ID NO: 387738 - DNA, 610 bp, Homo sapiens
  misc_feature: GZ8MTXP02HO96X.15.55.E11.1.454.CMB.2.raw
  modified_base (495)..(495): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctggttggagtcgtgggggaggcttggtacaggccgtggggggtccctggagactctcctgtgcagcctcaggattcgcctttcgcatctatgccatgacctggtccgccaggcctaccgaggggaaggggctgggagtggactcgtacagtctagttaggtggggtaggttggtaggtcggtaagaaacactaatagttacgcacggcttccggagaaacggggccctcttacaccaattccaccaaggacaactaaacttaccaaactaaaaccacttaaacctttttanacctttaacgaaaacttcgaaactacgccgtaggaccgacgaccgaacggactacgggactaactacgacttgacgcgaagaacgactacggacacggcccggtggacgtcccgg

SEQ ID NO: 387739 - DNA, 671 bp, Homo sapiens
  misc_feature: GZ8MTXP02J0LYP.15.55.E11.1.454.CMB.2.raw
  modified_base (400)..(400): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacagccgtggggggtccctgagactctcctgtgcagcctcgaggtacttcgcctttcgctatctatcgccagtcgaccgtcgggtcccgccgaggcctccggaagggggaacggggcgtgggagtgggactcgtcagcttagttaggtgggtaggttgggtagtggtaagaaaaacnctaattaattccgacgacgggtcctccgggtaggaacggggccctacttacccgaccctatcctaccgaagtacgacctaaacttacccaaaacaacctaaccttaactttaactacctttaacaaaacttacgaaaccagtccctaggaccggaacggccggaaacggaccgaccgggtacgtaactaccgtacgtggacggacgaagtacgactaccggaaacgcgggcccggtagggaccgtcccgtagaccgtacgggtacccgggg

SEQ ID NO: 387740 - DNA, 568 bp, Homo sapiens
  misc_feature: GZ8MTXP02GZ5C7.15.55.E11.1.454.CMB.2.raw
  modified_base (339)..(339): a, c, t, g, unknown or other
  modified_base (354)..(354): a, c, t, g, unknown or other
  modified_base (403)..(403): a, c, t, g, unknown or other
  modified_base (453)..(453): a, c, t, g, unknown or other
  modified_base (481)..(481): a, c, t, g, unknown or other
  modified_base (500)..(500): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttaggggtcactcaccctgccccgatacgtgacnggacctggtctcggngagcggctttcaccgtctttatcgttactatgtcagcattcgctcttcngactacctcagcatcgcctacacagcacaccttcacagcttacagaaccncctacccaccaacacacatacgcgtacnctcgccgcacgtcttcggnacgtacgttcggttaccgtccccgtttacacgttccctcccgctactcgtagacgtacgtaacgtacg

SEQ ID NO: 387741 - DNA, 547 bp, Homo sapiens
  misc_feature: GZ8MTXP02FJYAT.15.55.E11.1.454.CMB.2.raw
  modified_base (346)..(347): a, c, t, g, unknown or other
  modified_base (352)..(352): a, c, t, g, unknown or other
  modified_base (355)..(355): a, c, t, g, unknown or other
  modified_base (357)..(357): a, c, t, g, unknown or other
  modified_base (359)..(360): a, c, t, g, unknown or other
  modified_base (365)..(370): a, c, t, g, unknown or other
  modified_base (373)..(374): a, c, t, g, unknown or other
  modified_base (377)..(378): a, c, t, g, unknown or other
  modified_base (392)..(392): a, c, t, g, unknown or other
  modified_base (395)..(395): a, c, t, g, unknown or other
  modified_base (405)..(405): a, c, t, g, unknown or other
  modified_base (417)..(417): a, c, t, g, unknown or other
  modified_base (453)..(453): a, c, t, g, unknown or other
  modified_base (466)..(466): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgccttcggcctcgccttagggcactcaccctgcccgatacgtgacagacctgctcgnngcggnttncntnntactnnnnnntcnntcnncactcagcatgctnacngcacactcanacgctacagacnctacccacgaacacgcataacgcgtcgctcgcccgnacggctttcgggnacctagttcgggttaactcccccgttttacaccgttcccgttaacccgcttacgtcgtacgtacgtaccgttaacggtacg

SEQ ID NO: 387742 - DNA, 625 bp, Homo sapiens
  misc_feature: GZ8MTXP02HL0A9.15.55.E11.1.454.CMB.2.raw
  modified_base (211)..(211): a, c, t, g, unknown or other
  modified_base (239)..(239): a, c, t, g, unknown or other
  modified_base (250)..(250): a, c, t, g, unknown or other
  modified_base (295)..(295): a, c, t, g, unknown or other
  modified_base (447)..(447): a, c, t, g, unknown or other
tcagtctacgtagccacgaccggtgctcgatttagcactcgcacgttgggtttgggggaggcttggtacagcctgggggggtccctgagactctcccgtgcagcctcaggattcgcctttcgcatctatgccatgacctgggtccgccaggctccagggaagggctggagtggatctcagctattagtggaggtggtagtggtagaaaacncatattacgcaggctccgtgaagggccncttcaccatcncagagacaattccaaacaacactactttatcttacaaatgaacancctgcgagccggaggaccacggccgtaatactatgtgcgagagatacgaacgacgggccgtggggacgtcccgtgactacgcggggacagggaccctggtccacgtctcgtacaacctccacgacggcccacgtccgtccctcccgtcgccnccccgtccaccgaagtacgcctaccgtcggtcggggaccacgtacggcccggtcccggtcggaccgtcggtccgtcgggtaccgaaccggttaccgtaccgttcccggtacgttaccggtaacggtacgtacggacggccggggaacgtacgggacgtaacggcgtacgacgtacgcg

SEQ ID NO: 387743 - DNA, 605 bp, Homo sapiens
  misc_feature: GZ8MTXP02HFV3V.15.55.E11.1.454.CMB.2.raw
tcagtctacgtagccacgaccggtgctcgatttagcactcgcacgttgggtttgggctgaactggctttttcttgtggctattgtaaaaggtgtccaatgtgaggtgcagctgttggagtctgggggaggcttggtacagcctggggggtccctgagactctcctgtgcagcctcaggattcgcctttcgcatctatgccatgacctgggtccgccaggctccgagggaagggctggagtggatctcagctattaggtggaggtggtagtggtagaaaacacatattacgcaggctccgtgaaggccgcttcaccatcctccagacgacaattccaaacaacactacttttatcccttacaaaatgaaacacgccctgccgacgccgaaggaccaccggccgtatactactgtgacgagagatacgaaacgacggcccgtgggacgcccgttagactacggtcggggaccacgggtaacccgtggtaccaccgtcctacccgtacaaccctccaaccgacgggcccacgttccgtcccttcccccgcggccctaccccgtccctaccgaacgtcgccctaacccgtcgtacgggggcaacgccgg

SEQ ID NO: 387744 - DNA, 614 bp, Homo sapiens
  misc_feature: GZ8MTXP02IYAZC.15.55.E11.1.454.CMB.2.raw
  modified_base (350)..(350): a, c, t, g, unknown or other
  modified_base (416)..(416): a, c, t, g, unknown or other
  modified_base (419)..(419): a, c, t, g, unknown or other
  modified_base (424)..(424): a, c, t, g, unknown or other
  modified_base (465)..(465): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctaacacgacttaaaccgggacaaccgtccgcccggaccaacatacgccttcctcccgtccccccttgcagtaaccaccaagtacaggaatattaacctgttcccatcgactacgcttcgcctcgcgttagggcactcacctgcccatacgtgacagacctgtctcgngagcggtctttcgaccgtctttatcgttacttatgtacagctattcgctacgttctgacttacccncancatcncctacacacacactacctacacacgtactacacgtaacccnccctaaccccaacccaacgaaccgactaaacgaaccgccgtcgcgtcgcccgacgtacgtcgttcggtctaccgttacgttaccgtttacccgtcccgtttctaccgttcccgtaacccgtactacgtcgtacgacgtacgtacgtacg

SEQ ID NO: 387745 - DNA, 540 bp, Homo sapiens
  misc_feature: GZ8MTXP02FVHEK.15.55.E11.1.454.CMB.2.raw
  modified_base (344)..(344): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggcttttcttgtggctattgtaaaaggtgtccaatgtgaggtgcagctgttggagtctgggggaggcttgggtacagccgtggggggtcccctgagactctcctgtgcagcctcaggattcgcctttcgcatctatgccatgacctgggtccgccaggctccgaggggaaggggctgggagtggatctnagctattagtggaggtggtagtggtagaaacacatattacgcaggctcgtgaaggccgctcaccatcctccagagacaattccaaacaacactactttatcttacaaaatgaaacagcctgcgagccgaggacacgggcctaatacctacgtgtacgcgagaagactcgaaacgacggcccgtggggactccccgg

SEQ ID NO: 387746 - DNA, 567 bp, Homo sapiens
  misc_feature: GZ8MTXP02F2WBN.15.55.E11.1.454.CMB.2.raw
  modified_base (213)..(213): a, c, t, g, unknown or other
  modified_base (272)..(272): a, c, t, g, unknown or other
  modified_base (277)..(277): a, c, t, g, unknown or other
  modified_base (305)..(305): a, c, t, g, unknown or other
  modified_base (347)..(347): a, c, t, g, unknown or other
  modified_base (362)..(362): a, c, t, g, unknown or other
  modified_base (386)..(386): a, c, t, g, unknown or other
  modified_base (544)..(544): a, c, t, g, unknown or other
tcagtctacgtagccacgaccggtgctcgatttagcactcgcacgttgggtttgggctgaactggctttttcttgtggctattgtaaaaaggtgtccaatgtgaggtgcagctgttggagtctgggggaggcttggtacagcctgggggtccctgagactctcctgtgcagcctcaggattcgcctttgcatctatgccatgacctgggtccncaggctccgagggaagggctggagtggatctcagctattagtggaggtggtagtggtanaaacnatattacgcaggctccggtgaagggccnttcaccatcctcagacgacaattccaaacaacacaactttanccttacaaatgaacngcctgcgagccgaggacacgctanactactgtgcgagagatacgaacgacggccgtgggacgccgttagaccttacggcggggaccaacggggtaaccctggtacccaccggtctccctaccaaccctccgaccgaacggcccagtccgtcctccccgtcgcccacccctctaccaacgacnccacctcgtcggggccaacgcgg

SEQ ID NO: 387747 - DNA, 673 bp, Homo sapiens
  misc_feature: GZ8MTXP02GNM5C.15.55.E11.1.454.CMB.2.raw
  modified_base (211)..(211): a, c, t, g, unknown or other
  modified_base (238)..(238): a, c, t, g, unknown or other
  modified_base (245)..(245): a, c, t, g, unknown or other
  modified_base (248)..(248): a, c, t, g, unknown or other
  modified_base (253)..(253): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtagaaaacncatattacgcaggctccgtgaaggccncttcacntcncaganacaatccaacacacactttatcttacaaatgaacagcctgcgagccgaggacacggcctatactactgtgcgagagactcgaacgacggcccccgtggggaccgtcccgttgaccgtacggtcggggcccgtaaggggaaccccctgggtacccacccggttcctaccccgtacccgaaacccctacccgaaacccgaaaccggggccccctaacgttccccgggttcccctttccccccgtcggcccctacccccgtccctacccgaaacggaccgacccaccccgttcggtaccgggggccaccgacggcccggcccgtgggccgtcggccgtggtaccgaaacggtccttaccgttcccggacgtacgttacgaccgtcggacggccgggtcgtacgggacgaacggcgacgagtag

SEQ ID NO: 387748 - DNA, 589 bp, Homo sapiens
  misc_feature: GZ8MTXP02IRWIY.15.55.E11.1.454.CMB.2.raw
  modified_base (358)..(358): a, c, t, g, unknown or other
  modified_base (381)..(381): a, c, t, g, unknown or other
  modified_base (409)..(409): a, c, t, g, unknown or other
  modified_base (462)..(462): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggcttttcttgtggctattgtaaaaggtgtccaatgtgaggtgcagctggttggagtcgtgggggagcgttggtacaggccgtggggggtccctggagctctcctgtgcagcctcaggcttcgcctttcgcatctatgccatcgaccgtggtcccgccaggctccgaggggacgggctgggagtgatctcagtctagttaggnggaggtggtaggtggtaagaacnctatactacgcaggctcggagacggccnctacacatcctcagacacactaccaaacaactacctaatttacgtaccttaanaaatacgaaacacgtccgtacgacgacgaccgaacggaaccgtaccgtaccgtaactaccgtacgttcgacgacggaaagaacgacgtacggaaaccggcggtacccgggtacggggaccctaccgg

SEQ ID NO: 387749 - DNA, 587 bp, Homo sapiens
  misc_feature: GZ8MTXP02IIUI9.15.55.E11.1.454.CMB.2.raw
  modified_base (449)..(449): a, c, t, g, unknown or other
  modified_base (461)..(461): a, c, t, g, unknown or other
  modified_base (570)..(570): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttgcagtaacaccaagtacaggaatattaacctgtttcccatcgactacgcctttcggcctcgccttaggggtcactcaccctgccccgattaacgtgacaggaacctgtctccggcgagcgggtctttcacccgtctttatcgttacttactgtcagctattcgctcttctgactaccctccagccactgcctcacagcacactcacngctacacgtacncctacccaaccaacacgacataacgcgtacgctacgcccgcacgcttcggacgtctacgttcggtttaccgtccccgtttacaccttcccgttaacccgcccagttccngtaccgcgttacgtacg

SEQ ID NO: 387750 - DNA, 672 bp, Homo sapiens
  misc_feature: GZ8MTXP02H2MBZ.15.55.E11.1.454.CMB.2.raw
  modified_base (266)..(266): a, c, t, g, unknown or other
  modified_base (275)..(275): a, c, t, g, unknown or other
  modified_base (418)..(418): a, c, t, g, unknown or other
  modified_base (524)..(524): a, c, t, g, unknown or other
  modified_base (542)..(542): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggaggcgttggtacaggccgtggggggtccctgagactctctgtgcngcctcaggnttcgcctttcgcatctatgcccagtcgaccgtcgggtcccgccgaggcctaccggagggggaacggggtcgtgggaaggtggtatcgtacgtagtacttaagttagggtaggggtagggttagggttaggtagggaagaaacncgtaataacgttacgcgaggtcctacggtggaaacgggccgtcctaccgaccactcctaccaaggacaacctattaacccaaactaaacctacctaactttttaanaccgtttaacaaagttanaaaccacgtacccaggcccgaagcccggaacggaccgtaaccggtccgttaaactaccggtactcggtacgaccggaagaacgtaccgacggaacggaccggacccgggtacggggtaacccgtcccggg

SEQ ID NO: 387751 - DNA, 635 bp, Homo sapiens
  misc_feature: GZ8MTXP02FVA0D.15.55.E11.1.454.CMB.2.raw
  modified_base (360)..(360): a, c, t, g, unknown or other
  modified_base (410)..(410): a, c, t, g, unknown or other
tcagtctacgtagccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacagaatattaacctgttccatcgactacgccttcggcctcgccttagggcactcaccctgccccgattaacgttgacacggacccttggtcttccggcgngcgggtcttttcgacccgtctttactcgttactactgtcagctattcgcncttctgactaccctcagctatcgcctacacacgcacctaccttcacaggtccttaacacgaaccgccctaccccctaacccaaacgaaccgaccaataaccgccgtaccgctcgcccgacgtacgtccgttcggtcgcttaacgtttcgggtttaacctcccccgtttttaccaccgtttccccgttcccgtacctacgttccgtaggaccgtacttaacggacg

SEQ ID NO: 387752 - DNA, 744 bp, Homo sapiens
  misc_feature: GZ8MTXP02HYRC9.15.55.E11.1.454.CMB.2.raw
  modified_base (258)..(258): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggaggcttggtacagccgtggggggtccctgagactctcctgtcncagcctcgaggtacttccggtaccctttcgctatctatcgacccaatcggaccgtcgggtacccgccgaggcctaccggaggggaacggggcgtagggaaggtggaacgttcctcgagtacgttaagtttaggaggggtaggttgggtaacggttaggtaaaggaaaaaccaataagttaacgttaccggacgtaaacgggtcccttacccggggtaagggaaccggggtccctaccttaacccgaccctaagttcccacccgagaaacgtaacctaaaacttacccaaaaaccaactacccttaactttaacctactttaccaaaaggtacgaacacgacctaggcccaagcccggaagaaccgaccggtacctaacgttacccgtacgttaggacgaccggacggaagaaccgtaccggaaaccgaaccggggccccggtaaagggccccgtacccgtttacggaaccgttacgggcccggggg

SEQ ID NO: 387753 - DNA, 671 bp, Homo sapiens
  misc_feature: GZ8MTXP02FR19Q.15.55.E11.1.454.CMB.2.raw
  modified_base (527)..(527): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacaggccgtgggggtccctgagactctcctgtgcagcctcaggtattccgcctttcgcatctatgccagtcgaccgtgggtcccgccgaggcctaccggaggggaacggggctgggagtgggactctcgagtcttagttagggtgggtagggttcgggtaggtgggtaaacgaaaacgataacgttaagttaccggcgaacgggtccttaccgggtaggaaacggggtccctcttaccaacctactcctaccgaagaacgaactaacttacccaaaactaaccaactacgtttaatcccttaanaaatcgaaacacgtcccagaccgaggcccggaagtacccgacggtctaagtaaacgtcgtggtacgacgtacggagtacgtaccggaaaacggccgggacccggtagggacccgtcccggttaagaccgtacgggtaccggggg

SEQ ID NO: 387754 - DNA, 621 bp, Homo sapiens
  misc_feature: GZ8MTXP02FFAH3.15.55.E11.1.454.CMB.2.raw
  modified_base (360)..(360): a, c, t, g, unknown or other
  modified_base (373)..(373): a, c, t, g, unknown or other
  modified_base (399)..(399): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttctgtggctattagtaaaaggtgtccaatgtgaggtgcagtctgttggagtcgtgggggaggtcttggacaggccgtggggggtccctgacgactctcctgtgcagcctcgaggtacttccgtcctttcgcatctatcgcctatcgaccgtgggtccgccgaggctacgaggggacgggctagggagtggactcganagtctagttaggngggaggtcggtagtggtaacgaaacncgaatacgttacgcgaaggtcctaccgggtaggaacgggtccctacttaccaaccactcacccgaagaacgtactaaacttcccaaaacaactacttacttttacgccttaaacgaaattcgaaacctgaccctgaccgagcccgaaggaccacggcctaataccgtacgtggacacgaagaagacgaccggaaacgcgggcccggtggggaccttacccgg

SEQ ID NO: 387755 - DNA, 578 bp, Homo sapiens
  misc_feature: GZ8MTXP02HTTKN.15.55.E11.1.454.CMB.2.raw
  modified_base (211)..(211): a, c, t, g, unknown or other
  modified_base (238)..(238): a, c, t, g, unknown or other
  modified_base (293)..(293): a, c, t, g, unknown or other
  modified_base (336)..(336): a, c, t, g, unknown or other
  modified_base (344)..(344): a, c, t, g, unknown or other
  modified_base (359)..(359): a, c, t, g, unknown or other
  modified_base (373)..(373): a, c, t, g, unknown or other
  modified_base (403)..(403): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtagaaaacncatattacgcaggctccgtgaaggccncttcaccatctccagagacaattcccaaacaacacactttatcttcaaatgaacngcctgcgagcccgaggacacggccgtatactactgtgcgaganatcgaacnggcccccgtgggacncccgttgactacgnggggccaggggaccctggccaccgtctccnccacctccaccacgggcccacgtccgttccttcccccgtcgcccaccccgtccctaccaacgacgccacctccgtcgggggccaccgacgccggcccgtcgggctcgccgtcggtcaacggacttacctccgcgtaccgtagacgtgaggtccgggcgtcgggcaaggcgcatag

SEQ ID NO: 387756 - DNA, 681 bp, Homo sapiens
  misc_feature: GZ8MTXP02HPZYI.15.55.E11.1.454.CMB.2.raw
  modified_base (405)..(405): a, c, t, g, unknown or other
  modified_base (557)..(557): a, c, t, g, unknown or other
  modified_base (637)..(637): a, c, t, g, unknown or other
  modified_base (670)..(670): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtcaatgtgaggtgcagctggttggagtcggtggggggagtcgtttggtacgacggcccggtcgggggggtcccctggacgaccttccttcccgtggtcgccacgcccgtcgaggtcttccggtccctttcgcctattcctatcgaccagtcggacccgtcgggtcccgccgacggcctacggagggggaaggggcgtagggaggtggactctacgagtnttaagttaggtgggtagggttagggtagtaggtaagaaacctagtaattaacgttaccggacgtacgggccgttccgggaggaccgggccctacttacacctagtccctaacgagaacaacctaacgttaccaaaacactaacttactttanacttaacaaagacgaacacggcctaggaccgacgccgggaaacgttaccgaccgggttaccaattaccgtacgtggacgngtaagaagtcgaacgaaccggcgggtacccggnggtaccgtcgg

SEQ ID NO: 387757 - DNA, 654 bp, Homo sapiens
  misc_feature: GZ8MTXP02JCNV6.15.55.E11.1.454.CMB.2.raw
  modified_base (454)..(454): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacagccgtgggggtccctgagactctcctgtgcagcctcaggtacttcgcctttcgctatctatcgccatgacccgtgggtcccgccgacggcctccggaaggggaacggggctggggagtggactcgtcagtcttagttaggtgggagggttggtaggtggtaagaaacactatattacgcgacggtctacccggtaggaacgggccctacttacacctactcnccagaacgaactaacttacccaaaacaactaaacctaccttttaatacctttaacaaaattcgaaactacgccctaggaccgacggcccgaacggacccacggggtaccttaacgaacccttacgtggtacgacggaaacggaacgtacgtaaccggaaaccggaccgggggccccggttagggggaccgtttacccggg

SEQ ID NO: 387758 - DNA, 553 bp, Homo sapiens
  misc_feature: GZ8MTXP02GUQDO.15.55.E11.1.454.CMB.2.raw
  modified_base (352)..(352): a, c, t, g, unknown or other
  modified_base (374)..(374): a, c, t, g, unknown or other
  modified_base (418)..(418): a, c, t, g, unknown or other
  modified_base (430)..(430): a, c, t, g, unknown or other
  modified_base (443)..(443): a, c, t, g, unknown or other
  modified_base (502)..(502): a, c, t, g, unknown or other
  modified_base (512)..(512): a, c, t, g, unknown or other
  modified_base (521)..(521): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtctgggggaggcttggtacagcctggggggtccctgagactctcctgtgcagcctcaggattcgccttcgcatctatgccatgacctggtccgccaggctccgagggaacggggctgggagtggatctcagtctagttagnggaggtggtagtggtagaaacncatatacgcaggctccgtagaaggcctctcacatcctaccaganacaattccaaanacactaactttancttacgaaatcgaaacagctacgcgaacgccgtaaggacaccgggcctactaacctacncgtcgcgaanaaggtaacncggaaaacgcggacccgtaggggaccgtcccg

SEQ ID NO: 387759 - DNA, 645 bp, Homo sapiens
  misc_feature: GZ8MTXP02FTUM4.15.55.E11.1.454.CMB.2.raw
  modified_base (275)..(275): a, c, t, g, unknown or other
  modified_base (373)..(373): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctggttggagtcgtgggggagcttggtacagccgtggggggtccctggagactctcctgtgcagcctcaggnttcgtcctttcgctatctatcgccatcgacctcgggtccgccaggcctaccgaggggaaggggctagggagtggactctacaggtcttagtttagggngggtaggttagggtaggtaggtaacgaaaacgctaagttaacttacgcgtaacggctcccgggtaggaacgggcccgtcttaccactacttccaccgagaaccgtaacaaacttaccaaaacaaacctaactaactttactaccttaacaaataacggaactacgccgtacgacgacggacccgaacggaccgacgggtacctaactaccgtacgtgtacgaccggaagaagtactacggaacgaccgggaccggtacgggaccggtacccg

SEQ ID NO: 387760 - DNA, 701 bp, Homo sapiens
  misc_feature: GZ8MTXP02JQ95Z.15.55.E11.1.454.CMB.2.raw
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggctttttcttgtggctattgtaaaaggtgtccaatgtgaggtgcagctgttggagtcgtgggggaggcttggtacaggccgtggggggtccctgagactctcctgtgcagcctcaggtattccgcctttcgctatctatcgccatcgaccgtcgggtcccgccgaggcctaccggaggggaggggctgggagtggatctcgagtctagttaggtgggaggtggtacggtaggtaagaaactactaatacgttaccgcgtaacgggccttaccgggtagggaaccggggtcccgtaccttaccgaaccctactcctaccgaaagaacgaactaaacttaacccaaaactaaacctaacttaaccttttactaccgtttaaacaaaacgttacgaaaacctacgtccttacgggaccgacggaacccggaacgggaacccgtaccgggtaccgttaaactaaccgttacgtagggacgaccggaaaggtaacgaacgtaaccggaaaacggccggggtacccgggtacggggacccgttaccccggg

SEQ ID NO: 387761 - DNA, 615 bp, Homo sapiens
  misc_feature: GZ8MTXP02JP65B.15.55.E11.1.454.CMB.2.raw
  modified_base (215)..(215): a, c, t, g, unknown or other
  modified_base (279)..(279): a, c, t, g, unknown or other
  modified_base (285)..(285): a, c, t, g, unknown or other
  modified_base (312)..(312): a, c, t, g, unknown or other
  modified_base (363)..(363): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtctggggggaggcttggtacagcctggggggtccctgagactctcctgtgcagcctcaggattcgcctttcgcatctatgccatgacctgggtccnccaggctccgaggggagggctgggagtggatctcagcttagttaggtggaggtggtagtggtanaaaacncatattacgcaggctcgtagagggccncttcacatctcagagacaatccaacaacactactttataccttacaaaatnaacagcctagcgagcgaggacacgtcgtaatactactgtgcgagagagtcgaacgacgggacccggtgggacgtcccgttaggacctacggtcgggggaccgaacgggaaccctcggtacccgaccggtcctcccgtaccaaccctcccgaaccgaacgggtcccacgttccggtccctcccccgttcggccctaacccccgtcctacccaacgccgacctacccgtacggtccgggggaccaacgcccggg

SEQ ID NO: 387762 - DNA, 557 bp, Homo sapiens
  misc_feature: GZ8MTXP02G7YZ7.15.55.E11.1.454.CMB.2.raw
  modified_base (229)..(229): a, c, t, g, unknown or other
  modified_base (236)..(236): a, c, t, g, unknown or other
  modified_base (403)..(403): a, c, t, g, unknown or other
  modified_base (438)..(438): a, c, t, g, unknown or other
  modified_base (456)..(456): a, c, t, g, unknown or other
  modified_base (472)..(472): a, c, t, g, unknown or other
  modified_base (510)..(510): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccaggggaaggggctggagtggatctcagctattagtggaggtgttagtggtagaaaacacatatacgcaggctcgngaggccnttcacatctcagagacaattccaacaacactactttatcttacaaatgaacagcctgcgagccgaggacacggccgtaatacgtactggtagcgagagactacgaacgacggcccccggtaggacgtcccgtgactacgcggggccaggggaccctggccaccgtcncctacacctccacgacgccacgtccgtcctccccngcccaccctccacaagcncaccgtcgcgggcacncgccgccgtggctcgcgtcgacgacgaccttcgtaccncgtacgtacgaccgtgacggtcggcgtacggcgaacggcgacagacg

SEQ ID NO: 387763 - DNA, 774 bp, Homo sapiens
  misc_feature: GZ8MTXP02G81MG.15.55.E11.1.454.CMB.2.raw
  modified_base (243)..(243): a, c, t, g, unknown or other
  modified_base (252)..(252): a, c, t, g, unknown or other
  modified_base (257)..(257): a, c, t, g, unknown or other
tcagtctacgtagccacgaccggtgctcgatttagcactcgcacgttggggtttgggggaggcttggtacagcctgggggggtccctgagactctcctgtgcagcctcaggattcgcctttcgcatctatgccatgacctgggtccgccaggctccaggggaaggggctgggagtggatctcagctattagtggaggttgttagtggtagaaaacacatattacgcaggctccgtgaaggccnttcacatcncaganacaattccaacacactactttatcttacaaatgaacacgcctgacgagccgaggacgaccggccgtaatactactggtgacgagagatcgaaacgacggcccccgtaggggacctcccggttagaccgtacggtcggggcccggtaacgggaacccccgttgggtaccctaccccggttacttccccctaacccgtaacccgttacccgaaaccccggtaaccggggcccctaacgttcccggggtttacccccttccccccggtcggtaccccctacccccgtaccctacccgaaaaccggccgtacccgtaacccgttccgggtaccgggggaccctaaaccggtacccgggacccgggtcccccggttgggggaacccgttcccgggtccgttacggggtaacctaaccggggtaaccctttacccggttacccggtaaccggttacggttacgaacccggttggaacgggcccgggttacgtaccgggaccggaaccgcggtaccaacgtcgg

SEQ ID NO: 387764 - DNA, 799 bp, Homo sapiens
  misc_feature: GZ8MTXP02J3U71.15.55.E11.1.454.CMB.2.raw
  modified_base (250)..(250): a, c, t, g, unknown or other
  modified_base (319)..(319): a, c, t, g, unknown or other
  modified_base (414)..(414): a, c, t, g, unknown or other
  modified_base (420)..(420): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagtcttggtacaggccgtggggggtcccngagacctctcctgtgcagccctcgaggacttcgcctttcgctatctatgccatcgaccgtcgggtcccncgaggcctaccggaaggggaacggggtctaggggacgttgggactcgtacgagtacttaagttagggtgggtaggggttcggtagtggggtaaanaaaccncgtaaattacgttacgacgacgggtaccgtttcccgggagggaaacccgggggtccctaccgttttaacccgaaacccgttaaccctacccgtaaccgaaacggtaaacctaaaacccttaaacccttaaaccccaaaacctaaacccttaacctttaacctttaacttaaccttaaaccggaaaacgtaccgaaaccgtaccggtaccggtaacggacccggtaaccggaaccccggggaaacggttaaccccggtaacccggttaaacccttaaacgtacccgttacggtacggacggaaccggaaacggtaacggtaaccgaacccgggaaccggggtacccgggtccccggggtaacgggtaccccggtacccgg

SEQ ID NO: 387765 - DNA, 619 bp, Homo sapiens
  misc_feature: GZ8MTXP02FHHS6.15.55.E11.1.454.CMB.2.raw
  modified_base (265)..(265): a, c, t, g, unknown or other
  modified_base (270)..(270): a, c, t, g, unknown or other
  modified_base (305)..(305): a, c, t, g, unknown or other
  modified_base (374)..(374): a, c, t, g, unknown or other
tcagtctacgtagccacgaccggtgctcgatttagcactcgcacgttgggtttgggggagagaggagcccagccctggggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacaggccgtggggggtccctgagactctcctgtgcagcctnaggtntcgcctttcgcatcatgccatcgacctggggtccnccgaggctccgaggggagggctggagtggatctcagtctataggtggaggtggtagtggtaagaaaacncaattagttaccgcgaacgggcctacccgtagggaacggggccctacgtttaccattaccgacttcctaccgaggacaacctaaacttacccaaacaaacctactaactttatacttaacaaaatagaaacagtcccctaggacgaacggcccggaaggaccgtacggaccgtaactactacgttgagacgagagactacggaacgacggaccggtacggggaccgtccgttacgaccgtacggg

SEQ ID NO: 387766 - DNA, 625 bp, Homo sapiens
  misc_feature: GZ8MTXP02GNG1S.15.55.E11.1.454.CMB.2.raw
  modified_base (241)..(241): a, c, t, g, unknown or other
  modified_base (350)..(350): a, c, t, g, unknown or other
  modified_base (625)..(625): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgaggggaaggggctggagtggatctcagctattagtggaggtgttagtggtagaaaacacatattacgcaggctccgtgaagggccncttcaccatctccagagacaattcccaaacaacactactttatcttacaaatgaacagcctgcgagccgaggacacggccgtaatactactgtccgagagatacgaacngggcccgtgggacgtcccgttgacctacgtcggggaccacggggaaccctgggtccacccgtctcctaccaaccctccaccgaacggcccacgtccgtcccttcccccgtcggccctacccctccctaccaacgacgaccacccgtcggtcgggggccaccgacggcccggcccgtcgggcctcggccgtcgggacgaacggtacctaccgttccgtaccgtaccggtacgaccgtcggacggcgggtcgtcggacggaacggcgacacgtacgn

SEQ ID NO: 387767 - DNA, 677 bp, Homo sapiens
  misc_feature: GZ8MTXP02JAME4.15.55.E11.1.454.CMB.2.raw
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacagccgtgggggtcctgagactctcctgtgcagccctcaggtacttccgcctttcgctatctatcgccagtcgaccgtgggtcccgccgaggcctaccggagggggaacggggcgtagggaggtcggactctcgagtcttagttaggtgggagggttggtaggtacggtaagaaacgactaaagttacgttaccgcgtaacgggtccgttacccgggagggaaaccggggtcccctactttaccacctaacttcccgtacccgaagacgaaaacctaaccgttaccaaaacaacctaacttaactttttaagaccctttaagaaattcgaaacctagcccgtagccgaacgaccggaagaaccgacggtaccgttaataccgtacgttaggacgacggaagcgaaacgtcgaaaaccggcgggtcccggaggggtaccctaccccgg

SEQ ID NO: 387768 - DNA, 805 bp, Homo sapiens
  misc_feature: GZ8MTXP02IY83K.15.55.E11.1.454.CMB.2.raw
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctggttggaggtcggtggggggaggtcgtttgggtacgacggtcccggttggggggggttcccctggacggtaccttccgttcccgttggtcgaccacggcccttacgagggtacttcggtcctttccgctactctatcgccatcggaccgtcgggtcccgccgacggcctacccggaagggggtaacggggccttaggggagtcggactcctcgagtacttagttagggtgggagggttggttaggtaggtacgaaactactaattaagttacgacgtacggtccgtaccgggtagggaacggggtccctacgttaccgaaccctactaccgtacccgtaaaggtaaccgtaaacctaaaccttaccccgaaaaacctaaaccctaaacctttaaccttttaactaccctttaaactaaaaacgttacgaaaacccgtacggtacccctacgggaaccggaaccgggccccggaaacgggaacccggtaacggggtacccttaaacgttaaccgtaaccggttggtacggaccgtaagaaggtaaaccgttacggggaaaccgaccggggttcccggtacgggggaccgtttacccccggg

SEQ ID NO: 387769 - DNA, 686 bp, Homo sapiens
  misc_feature: GZ8MTXP02FHK9Y.15.55.E11.1.454.CMB.2.raw
  modified_base (360)..(360): a, c, t, g, unknown or other
  modified_base (411)..(411): a, c, t, g, unknown or other
  modified_base (418)..(418): a, c, t, g, unknown or other
  modified_base (433)..(433): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggaggcttggtacagccgtgggggtccctgagactctcctgtgcagcctcgaggattcgcctttcgcatctatcgccatcgaccgtggtccgccgtacggctcccggaaggggaacggggtctagggagtagggtacttcncgtaagccttacgtttaagggtggggagggttggggttaagtaggggtaanaaaaccnctaattacgtaccgngtacggacctacgggtaggaaccgggtcccttactacccaacctactcccgacgaaagtaacaaactaaacctaacccgaaaacaaacctacttaactttaactaccttaaacgaaataccgaaactacgtaccgtacggacgaacggaccgtaacggaccgtaccggtactaactaaccgtaacgtcggacgaacgaaggtaacgaacgaaccggaaccggaccggggtaccggtacgggtaccgtacccgg

SEQ ID NO: 387770 - DNA, 661 bp, Homo sapiens
  misc_feature: GZ8MTXP02GTLXI.15.55.E11.1.454.CMB.2.raw
  modified_base (216)..(216): a, c, t, g, unknown or other
  modified_base (290)..(290): a, c, t, g, unknown or other
  modified_base (324)..(324): a, c, t, g, unknown or other
  modified_base (336)..(336): a, c, t, g, unknown or other
  modified_base (371)..(371): a, c, t, g, unknown or other
  modified_base (378)..(378): a, c, t, g, unknown or other
  modified_base (383)..(383): a, c, t, g, unknown or other
  modified_base (387)..(387): a, c, t, g, unknown or other
  modified_base (399)..(399): a, c, t, g, unknown or other
tcagtctacgtagccacgaccggtgctcgatttagcactcgcacgttgggtttgggctgaactggctttttcttgtggctattgtaaaaggtgtccaatgtgaggtgcagctgttggagtctggggggaggcttggtacagcctggggggtccctgagactctcctgtgcagcctcaggattcgcctttcgcatctatgccatgaccgtgggtccnccaggctccgaggggaaggggctgggagtggatctcagtctattaggtgggaggtggtaggtggtaagaaaacnctaatattacgcaggcctccggtaggaacggccncttcaccatccncagacaacaacttaccaaacaactactacttttancccttanaaatnaacngcctagcggacnccggaacggaccgaccgggtacctatacctacgtggtgacgaaggaacgacgtacggaaccgacggggtcccggtaggggaccgtcccggttagaccgttaccgggacgggggacccgtaacggggtacccctgggtaccccacccgttctaccctacaccctacccgaccgaaccggccctacgttcccggtcccttcccccgcgtacccctaccccgttccaccgaacgtaccaccgacccgtcggacggccacgtccgg

SEQ ID NO: 387771 - DNA, 775 bp, Homo sapiens
  misc_feature: GZ8MTXP02JEM2S.15.55.E11.1.454.CMB.2.raw
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttctgtggctattgtaaaaggtgtccaatgtgaggtgcagctggttggagtcgtgggggagcttggtacaggccggttggggggtccctggacgtactctccgtgtcgcagcctcgaggtacttccgcctttcgcatctatcgcccaagtcgacccgtgggtcccgcccgaggcctaccggaaggggtaaggggccttgggaacggtggacttcgtacgtaacggtcttaagtttaggggaggggtaagggttggggttaacggtagggtaacgaaaaaacctcgtaaatttaacgttacccggacgtaacggggtcccgttaccgggtagggaaaccgggggtcccttaccctttaccacccgtacttacccgacccgtaaaggaacgtaacctaaacccttacccaaaacctaacctaaccttaaactttttacctacttttaaacggaaaaacttcgaaaaccgtcgtaccgtacggaaccgacgggtacccgggaacggaaccgtaccggggtaccgttaaactacttacgtggtaccgacggagtaacgtacgaccgaaacggtccggaccgggtacggacccggtaccggttacgtaccgtacggtaccgggg

SEQ ID NO: 387772 - DNA, 646 bp, Homo sapiens
  misc_feature: GZ8MTXP02IQHN7.15.55.E11.1.454.CMB.2.raw
  modified_base (214)..(214): a, c, t, g, unknown or other
  modified_base (242)..(242): a, c, t, g, unknown or other
  modified_base (258)..(258): a, c, t, g, unknown or other
  modified_base (331)..(331): a, c, t, g, unknown or other
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgcaggctccgaggggaaggggctggagtggatctcagctattagtgggaggtggtagtggtagaaaacanatattacgcaggctccgtggaacggccncttcaccatctcaganacacttaccaacaacactacttatcttacaaatgaacagcctgcgagccgaggaccacggcctatactcgtgngacgaagagacgtaccgaaacgcgggcccccgtagggaccgtcccgttagaaccgtacggtcggggaccgtaacgggtaaccctggggtcccaaccggttcctacccgtaccaaaccctacccgaaccgaacgggccctacgtcccgttcccttcccccgcgaccctaccctccgtacgaaacgcgacctaccgtcggcgggaccaacgcggccggtcccgtcgggcctcggtccgtacggtacgaacggtacctaccgtccgtacgtacggtacgacgtcggacggtcggcgtacggacgacggtcgacgagcg

SEQ ID NO: 387773 - DNA, 622 bp, Homo sapiens
  misc_feature: GZ8MTXP02FZZOE.15.55.E11.1.454.CMB.2.raw
  modified_base (412)..(412): a, c, t, g, unknown or other
  modified_base (456)..(456): a, c, t, g, unknown or other
  modified_base (459)..(459): a, c, t, g, unknown or other
  modified_base (483)..(483): a, c, t, g, unknown or other
  modified_base (490)..(490): a, c, t, g, unknown or other
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtctttttcttgtggctattgtaaaaggtgtaccaatgtgaggtgcagctggttggagtcgtgggggaggtcgttggtacgaggtccggtcggggggtccctggacgactcctcctgtgcagcctcgaggtacttccgtccttcgctactctatcgccagtcgaccgtcggtccgccgaggccgtacccggaaggggaacggggtctaggggagtggactctacgagtctagtaggtgggaggtggtagtagtaanaacgatatagtacgcgaggctcgagacggctctcacatcacganacncaaactcaaacacacttactttancgttaanaaagtcaaaccagtcccgtggaccgaggaccgaacggaccggaccgtaccgttaaataaccgttcggtcgacggagtaaacgcgttaaacgaacgaaaccggccggggaccggttacggggactaccccggg

SEQ ID NO: 387774 - DNA, 883 bp, Homo sapiens
  misc_feature: GZ8MTXP02IY65D.15.55.E11.1.454.CMB.2.raw
  modified_base (268)..(268): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcttggtacagccgtgggggtccctgagactctcctgtgcagcctcgaggtnttccggtcctttcgctatctatcgccatcgaccgtcgggtcccgccgaggcctaccggaaggggaacggggtccgtaggggaggtgggaacttcctaccgagtccttaagttaggtaggggtagggttgggttaagggtacgggtaaacgaaaaacctagtaaattaacgttaccgggcgtaaacgggtcctacccggggtagggaaaccgggggtccctacgtttacccgaacgtttaccgaactttacccgtaacccgaaagggtaaaccgtaaaacccttaaaaccgttaaccccaaaaaacccttaaaaccaaaccctttaaacctttttaaacggtaaacccctttaaacggttaaaacttaccgggtaaaacctaccggacccccgttagggaccggaaccgggaaccccgggaaacgggtaaccccggtaacccgggggtaaccccctttaaagtttaacccggttaaaccggttgggtaaacccggtaacgggaaaggttaaaccggtaacgtaaacccggggtaaaaccggccgggggtacccccggggttaagggggtaaaccccgtccccccgggtttaagggaaccccgtttaacccgggggg

SEQ ID NO: 387775 - DNA, 659 bp, Homo sapiens
  misc_feature: GZ8MTXP02GBZWD.15.55.E11.1.454.CMB.2.raw
  modified_base (267)..(267): a, c, t, g, unknown or other
  modified_base (317)..(317): a, c, t, g, unknown or other
  modified_base (355)..(355): a, c, t, g, unknown or other
  modified_base (486)..(486): a, c, t, g, unknown or other
tcagtctacgtagccacgaccggtgctcgatttagcactcgcacgttgggtttgggggagagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtcgtgggggagcgttggtacaggccgtgggggtccctggagactctcctgtcgcagcctanaggtattccggcccttttcgctatctatcgccaatcgaccgtgggtaccnccgaggcctccggaaggggtaggggctggagtggatcncagctagtaggtggaggtggtagtggtaagaaaacacaattagttccgcaagggtcctccgtaggaacgggccgtacttcatcactcctaccgaagagaactaaactaccaacaaacactaaacttttacncttaacgaaatgaaccacgtccctggacgacggtacccggaagtaccgaccggggtcctaaacttaccgttatagggttacgaaccggaagttaaccgaagtacccggaaaacggaaccgggcccggttagggggaccgtaccccgggtttagaacccggtttaacccggggg

SEQ ID NO: 387776 - DNA, 852 bp, Homo sapiens
  misc_feature: GZ8MTXP02JLF4N.15.55.E11.1.454.CMB.2.raw
tcagtctacgtagccacgaccggtgctcgatttagcactcgcacgttgggtttggggagctctgagagaggagcccagccctgggattttcaggtgttttcatttggtgatcaggactgaacagagagaactcaccatggagtttgggctgaactggtcttttctgtggctattgtaaaaggtgtccaatgtgaggtgcagtctggttggaggtcgtggggggaggtcgttgggtaccgaggccgtcggggggtccctggacgtacgtcctccgtggtcgcacgccgtctaggtacttcgcctttacgctacttcctagtcgaccctagtaccgaccgttcggggtcccctcccggacggtccgtccggaagggggtaacggggccgtagggtaggtgggactcgtcgagtacttaagtttaggtgggtagggttaggttacggtagggtaacgaaaccgtaactaagttaacgttaaccggacgtaacgggtccgttaccgggttaacgggaaacggggttccccgttaccgtttacccgaacccgttaaaccttcccgtaaccccgtaaagggtaacgtaaaacccttaaaccgtttaacccaaaaccggtaaaccctaaaacgttaccctttttaaacgaccttttaaacaaaaacgttaccgaaacgtaaccgtcccgtaacggacggtaaccgcccgggtaaaagggaccccctacggggttaaccccgtaaacgtttacccgtaacgttcggggtaacgaacccggggtaagtaacggaaccgttaaaacccggaaccgggtaccgggtcccccggggtaaaagggggtcccccgtttaccccggg

SEQ ID NO: 387777 - DNA, 511 bp, Homo sapiens
  misc_feature: GZ8MTXP01BLAXZ.39.39.D06.1.454.CMB.2.raw
  modified_base (227)..(227): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacagcatttcaggcagcgccccgaaactcttaatttatgtaggttctttcgtcggccctctacggggtttctagtcgctttctcccggctccgaagtctggcaacacggcctccctgaccatctctagactccaggctgagacgaggctgactattattgcagctcatatactgaagtcaatggtaattccacttgctgttcggcgttaggaacctagttcgaccgtcgttaggtcaacgtcccg

SEQ ID NO: 387778 - DNA, 496 bp, Homo sapiens
  misc_feature: GZ8MTXP01B0AXI.39.39.D06.1.454.CMB.2.raw
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctggttccaacagcattcaggcagcgccccgaaactcttaatttatgaggtctttcgtcggccctcacggggtttctagtcgcttctccggctccaagtctggccaacacggcctccctgacccatctctagactccaggctgagacgaggctgactattattgacagctcatatctgaatcaatggtattcacttgctgttcggcgaggaaccagttcgacgtcttaggtccaagcccg

SEQ ID NO: 387779 - DNA, 498 bp, Homo sapiens
  misc_feature: GZ8MTXP01EC3WI.39.39.D06.1.454.CMB.2.raw
  modified_base (226)..(226): a, c, t, g, unknown or other
  modified_base (268)..(268): a, c, t, g, unknown or other
  modified_base (368)..(368): a, c, t, g, unknown or other
  modified_base (466)..(466): a, c, t, g, unknown or other
  modified_base (491)..(491): a, c, t, g, unknown or other
tcagtcgcactagtcacgaccggtgctcgatttagtgacatctcgcagttctttgggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacngcattcaggcagcgaccccgaaatcttaatttatgtaggttctttcgtcggccctcgacggggttttctagtcgcttctccggctccaagtctggcaacncggcctccctgaccatctctagactccaggctgaggacgagctgactattattgcagctcatatactgaagtcaatgtaattcacttggctgttcggngaggaaccagtcgactcttaggtcngaacccg

SEQ ID NO: 387780 - DNA, 648 bp, Homo sapiens
  misc_feature: GZ8MTXP01DCD3R.39.39.D06.1.454.CMB.2.raw
  modified_base (222)..(222): a, c, t, g, unknown or other
  modified_base (246)..(246): a, c, t, g, unknown or other
  modified_base (298)..(298): a, c, t, g, unknown or other
tcagtcgcactagtcacgaccggtgctcgatttagtgacatctcgcagttctttgggggggtctcaggaggcagcgctctcaggacatctccaccatggcctggctctgctgctcctcacctctcactcagggcacagggtcctgggcccagtctggcctgacacagcctgcctcgtgtctgagactcctggacagtcgatcacatctctgcactggaaccngcagtgacgttggggtatgactangtctcgtggtaccagcaatatccaggcacacgaccccaaatcatctatttangagtcagtaatcggcccctgtaggtttcagtcgtacttctccggctccgtaagtcgtacggactaacgtacgggtcccttacccgtggtaaccctagttaccgttacgtaacgtaccttaccgaaggtccttacggtaacggtaccgtacggtaccgttacggtaacttagttaacgtcgtaccgtaacgtccgttaacgtacgttaacgtacgtacggtaaacgttccgtaaaagttcggttaaaccttcccgtaaacgttcgggttacccgttgggttacccgggaacgggtacgggtaacccgttaacgggttcggaaacccgtttcccggttaagggttaaccccg

SEQ ID NO: 387781 - DNA, 507 bp, Homo sapiens
  misc_feature: GZ8MTXP01AWN8Z.39.39.D06.1.454.CMB.2.raw
  modified_base (227)..(227): a, c, t, g, unknown or other
  modified_base (303)..(303): a, c, t, g, unknown or other
  modified_base (372)..(372): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctgttccaacagcattcaggcagccgaccccgaaatcttaatttangtaggtctttcgcgcctcgtacgggtttcagtcgcttctccgctccgaatctggcaacacggccctccngaccatctctagactcagctgagacgagctgactattatgcagctcatatactgaagtcaagtgtacttccgtacttggctggttcggcgggaacgggcctaaggttcgaccgtcgttagtccgaacgtaacccg

SEQ ID NO: 387782 - DNA, 512 bp, Homo sapiens
  misc_feature: GZ8MTXP01DMQBW.39.39.D06.1.454.CMB.2.raw
  modified_base (230)..(230): a, c, t, g, unknown or other
  modified_base (266)..(266): a, c, t, g, unknown or other
  modified_base (297)..(297): a, c, t, g, unknown or other
  modified_base (360)..(360): a, c, t, g, unknown or other
  modified_base (371)..(371): a, c, t, g, unknown or other
  modified_base (407)..(407): a, c, t, g, unknown or other
  modified_base (431)..(431): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccngcagtgacgttggtgcttatatatgtctctgtcaanagcatcagcagcgacccgaaactcttaattntgtagttctttcgtcgccctcgtacggggtttctatcgcttctctgctcagtctgcacactcncctcctgaccntctctggctcgagctgagacgagctctcttattatncagtctactatatacatctaattnttctacgtttgggtgttcgggcggacgggacccgtaaccgtacggtaaccgttcgttacggccgtaacgttcccgaacggg

SEQ ID NO: 387783 - DNA, 596 bp, Homo sapiens
  misc_feature: GZ8MTXP01ESSYU.39.39.D06.1.454.CMB.2.raw
  modified_base (273)..(273): a, c, t, g, unknown or other
  modified_base (329)..(329): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaagggctgagttggattggtagaaataaatgagaccgggggcaccaatacaangcgtccctcaggggtcagtcaccatatctgcagacaagtccaaagaacccacttcnccctgaggctgacccctctgtcgaccgccgcgactcggccatatattattgtgcgagtagttttgcgtaggtatcgttggggcggttatcgacgtcgtggggtacaaggggatcgaacgggtcacgttcgtcctccgtcaacggcccttcccgaaccgaaacggggccccaagttcccggttcccttccccccgttgggtcccgtccccgttcgcccttcccgaagggaccgtcccgaccccgtccggacgtaacgcccgaacccgg

SEQ ID NO: 387784 - DNA, 504 bp, Homo sapiens
  misc_feature: GZ8MTXP01BP1O1.39.39.D06.1.454.CMB.2.raw
  modified_base (226)..(226): a, c, t, g, unknown or other
  modified_base (359)..(359): a, c, t, g, unknown or other
  modified_base (496)..(496): a, c, t, g, unknown or other
tcagtcgcactagtcacgaccggtgctcgatttagtgacatctcgcagttctttgggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacagcattcaggcagccgccccgaaatcttaatttatgagtctttcgcggcctctacggggtttctagtcgcttctccgctcagtctggcaacncggcctccctgacccatctctagctccaggctgaggacgaggctgacttattattgcagctcatatactgaaagtcaaatggtaattccattggctgttcggcggttagggaaccaagttcgacccgtcttaggtcncgaacccg

SEQ ID NO: 387785 - DNA, 603 bp, Homo sapiens
  misc_feature: GZ8MTXP01B6127.39.39.D06.1.454.CMB.2.raw
  modified_base (227)..(227): a, c, t, g, unknown or other
  modified_base (266)..(266): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccngcagtgacgttggtgcttataatatgtctctgttccaangcattcaggcagccgaccccgtaaaattctttaaatttatggtacggttcttttcggtccggtcccttcgtacgggggttttctaggtccgtctttccgtcccggccttccgaaagttcctagggaccaaacgccgggtccctccctgaccctatctactagacctccgaggtctggagacgaggctgaacttattatgactagctcaattatactagtaaacgtctaaagtcggtaacttccctagttcgggtcgttcgggttcggggcggttaacggggtaacctaaagggtttccgaacccggttccgttaacgggtcccgaacggtaaccccg

SEQ ID NO: 387786 - DNA, 507 bp, Homo sapiens
  misc_feature: GZ8MTXP01B03D9.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctggttccaacagcattcaggcagcgaccccgaaatcttaatttatgagtctttcgtcggccctgacgggtttctagtcgcttctccggctccaagtctggcaacacggcctccctgaccatctctagactcaggctgaggacgaggctgactattattgcagctcatatactgaagtcaaatggtaattccgacttggctggttcgggcggaggaacctaagttcgacgtcttaggtcgaacgaacccg

SEQ ID NO: 387787 - DNA, 543 bp, Homo sapiens
  misc_feature: GZ8MTXP01AN3GY.39.39.D06.1.454.CMB.2.raw
  modified_base (273)..(273): a, c, t, g, unknown or other
  modified_base (329)..(329): a, c, t, g, unknown or other
  modified_base (435)..(435): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataatgagaccgggggcaccgaactacaangcgtccctcaggggtcgagtcaccatatctgcagacaagtccaagaacccacttcnccctgaggctgacccctctgtgacccgccgcggactcggccatatattatgtgcgagtagttttgcaggatcgttggggcgttatcgacgtcgtggggtcaagggntcgacggtcatcgtctcctcacgcctccaccaacgggccccaatccgggttccttcccccttgggcccgtcccttgccttccgaaggcgccaccctcgagcgcgaacg

SEQ ID NO: 387788 - DNA, 503 bp, Homo sapiens
  misc_feature: GZ8MTXP01DWJUY.39.39.D06.1.454.CMB.2.raw
  modified_base (229)..(229): a, c, t, g, unknown or other
  modified_base (408)..(408): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacagcattcaggcagccgaccccgaaactcttaaatttatgaggttctttcgtcggcctcgtacgggtttctagtcgcttctccggctcaagtctggcaacacggcctccctgaccatctctagactccagctgagacgngctgactattattgcagctcatatactgaagtcaatgtattccattggctgttcggcggaggaaccaagttgaccgtcttagtcaacgtaacccg

SEQ ID NO: 387789 - DNA, 504 bp, Homo sapiens
  misc_feature: GZ8MTXP01BQU3A.39.39.D06.1.454.CMB.2.raw
  modified_base (227)..(227): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacagcatttcaggcagcgccccgaaactcttaatttatgtaggtctttcgtcggccctctaggggtttctagtcgcttctccggctccaagtctggcacacggcctccctgaccatctctagactcccaggctgaggacgaggctgactattattgcagctcatatactgaagtcaatggtattccacttggctgttcggcggaggaaccaggttcgaccgtcttaggtcaagtcccg

SEQ ID NO: 387790 - DNA, 518 bp, Homo sapiens
  misc_feature: GZ8MTXP01DH6EV.39.39.D06.1.454.CMB.2.raw
  modified_base (229)..(229): a, c, t, g, unknown or other
  modified_base (269)..(269): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccngcagtgacgttggtgcttataatatgtctctggttccaangcattcaggcagcgaccccgaaatcttaatttatgagttctttcgtcgcctcgtacggggtttctagtcgcttctcccggctccaagtctggacaacgaccggccctccctgacccatcctctagactccgaggctggagacgaggctgacttattattgcagctcatatactgaagtcaatggtacttccagttggcttggttcggcggacggaaccaaggttcgaccgtcttaggtccgcgaacccg

SEQ ID NO: 387791 - DNA, 585 bp, Homo sapiens
  misc_feature: GZ8MTXP01D9I5F.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataatatgtctcctggttccaacagctattcaggcacgccgaccccgtaaattctttaaatttatgtaggttctttcgtccggtccctcgtacggggtttctagtcgtcttcgtccggctccagtctggacaacacggcctccctgaccatctctagacctcgagctggacggacgaggctgacttattattcgactagctacattaactactagaagttcaaagttggtaacttccgtaacgttgggtctttcgggttccgggcgggttaaacgggtaaccccttaaagggttccgtaaccccggttaccgttacgggttcccgaacggtaaccccgg

SEQ ID NO: 387792 - DNA, 530 bp, Homo sapiens
  misc_feature: GZ8MTXP01A27QH.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaaacagcattcaggcaggccgacccccgaaactctttaaatttatgtaggttctttcgtcggccctcgtacggggtttctagtcgcttctccggctccaagtctggcaacacggcctccctgaccatctctagactccgaggtctgaggacgaggctgactattatgcagctcatatactgaagtcaaatggtattcccaattggcttcggttcgggcgggagggtcctaaggttcgaacccgtcgttaggtcaacgaaccccg

SEQ ID NO: 387793 - DNA, 590 bp, Homo sapiens
  misc_feature: GZ8MTXP01CYDEN.39.39.D06.1.454.CMB.2.raw
  modified_base (228)..(228): a, c, t, g, unknown or other
  modified_base (271)..(271): a, c, t, g, unknown or other
  modified_base (348)..(348): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataatatgtctcctgttccaaacngctattcagcacgccgaccccgtaaatcttaatttatgacgttcttcgtcgcctgtacgggtttctagtcgtcttcncccggtctccgaagtccgtgggaccaaccgaccggtccctccctgacccattccgtcacgacctcaaggctaggaggaccgaggcctagaacttattacgttgactagtctactaattaatacctggtaaactcctaaagttggtaaacttccaacgttggtccgttgggtttaccgggcgggttaacgggtaactaacggttcgaccccggttacgttaggtaacccgaacgtaaccccgg

SEQ ID NO: 387794 - DNA, 522 bp, Homo sapiens
  misc_feature: GZ8MTXP01D3DUD.39.39.D06.1.454.CMB.2.raw
  modified_base (228)..(228): a, c, t, g, unknown or other
  modified_base (266)..(266): a, c, t, g, unknown or other
  modified_base (361)..(361): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgttcaangcatcagcagcgaccccgaaatcttaatttatgaggttctttcgtcgcctgtacggggtttctagtcgtcttctcccgctccaagtctggcaacncggcctccctgacatctctagactcaggctgaggacgaggctagacttattattgacagctcattaatctagaaagtctaagtggtaattcccgacgttggtcttggttacggcggttaagggaacctaaggtcgaaccgtcgttaggtccaagtaacccg

SEQ ID NO: 387795 - DNA, 538 bp, Homo sapiens
  misc_feature: GZ8MTXP01BW8KO.39.39.D06.1.454.CMB.2.raw
  modified_base (243)..(243): a, c, t, g, unknown or other
  modified_base (269)..(269): a, c, t, g, unknown or other
  modified_base (393)..(393): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtncttataatatgtctcctgttccaacngcattcaggcagccgaccccgaaactcttaatttatgtaggttctttcgtcggccctgtacggggtttctagtcgtcttctcccggctccgaagtctggcaacgacggccctccctgaccatcnctagactccgaggctgacggacgagctgacttattactgacagctcatatactgaagtcaaatggtacttccacgttgggtacttggttcgggcggttagggtaaccctaaggtttcgaccgtcgttaggtccgaagtaaccccg

SEQ ID NO: 387796 - DNA, 513 bp, Homo sapiens
  misc_feature: GZ8MTXP01DM7WE.39.39.D06.1.454.CMB.2.raw
  modified_base (373)..(373): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaaacagcattcaggcagccgaccccgtaaactctttaaatttatggaggttctttcgtcggcctcgtacggggtttctagtctcttctccgctccaagtctggcaacncgcctcctgaccatctctagactcagctgagacgagctgactattatgcagctcataatctagaatcaaatggtattccacttggtctgttcgggcggagggaacctaaagtcgacccgtcgttaggtcaacgaaccccg

SEQ ID NO: 387797 - DNA, 580 bp, Homo sapiens
  misc_feature: GZ8MTXP01CEYJ8.39.39.D06.1.454.CMB.2.raw
  modified_base (308)..(308): a, c, t, g, unknown or other
  modified_base (469)..(469): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgggtctcctggacagtcgatcaccatctcctgcactggaaccagcagtgacgttggtggttataactatgtctcttggtaccaacatccacccaggacaaagtccccaaactgatgatttangagtcaacgtaaacgcctagtaggggtttctaactcgtacttctctggacctccaagtctaggacaacgacggccctccctcgaccctatctcgtcgggcctcgaggctggacggacgagctctcttagttatgctagctcaatataacagtcctattacnctaagtttgggttaggttcgggacgggtaacgggaccgttaccgttcggttaacccggttcgttaacggtccgaacggccccgttaagggtcccgttccggtcccccccgg

SEQ ID NO: 387798 - DNA, 547 bp, Homo sapiens
  misc_feature: GZ8MTXP01BJMFG.39.39.D06.1.454.CMB.2.raw
  modified_base (363)..(363): a, c, t, g, unknown or other
  modified_base (371)..(371): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctgttccaacagcattcaggcagccgaccccgaaatctttaatttatgtaggttctttcgtcgcctcgtacggggtttctagtcgcttctccgctcatctgcacncgcctccngaccatctctagactccaggctgacggacaggctgacttatttattgactagctcatactactgaatctaaagtggttaacttcctaacgttggtccttgggttacgggcgggaacgggtaacccgtaaggtttcggtaacccggttccgttaacgggttccaacggtaaccccgg

SEQ ID NO: 387799 - DNA, 544 bp, Homo sapiens
  misc_feature: GZ8MTXP01EE00Q.39.39.D06.1.454.CMB.2.raw
  modified_base (268)..(268): a, c, t, g, unknown or other
  modified_base (368)..(368): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgttccaangcattcaggcagccgaccccgtaaattcttaaatttatgtagttctttcgtcgccctcgtacggggtttctagtcgcttcgtccgctcagtctggcaacncggcctccctgaccatctactagactccaggctggaggacgaggctgacttattatgctagctctaattactacttagaaagttcaaagttggtaacttccgtacgttggtacttgggttcggcgggaagggaaccctaagttcggaacccggtcgttagggtcccaagaaccccg

SEQ ID NO: 387800 - DNA, 552 bp, Homo sapiens
  misc_feature: GZ8MTXP01D793Y.39.39.D06.1.454.CMB.2.raw
  modified_base (270)..(270): a, c, t, g, unknown or other
  modified_base (306)..(306): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaangcattcaggcagccgaccccgaaattcttaaatttntgtagttctttcgcgccctgtacggggtttctagtcgtcttcgtcccggctccgaagtcctgggaccaaccgacgggcccttccctcgacccatcctactacgaccttccaggtctaggacggacgaggctagtacttattattgcagctctatttgactaatcagtgtaagtctttatcgttcgttagggaagttcgggaacttagggtctagtcgtcgtaggttccaacggttcccgaaaccgg

SEQ ID NO: 387801 - DNA, 513 bp, Homo sapiens
  misc_feature: GZ8MTXP01BJIM6.39.39.D06.1.454.CMB.2.raw
  modified_base (265)..(265): a, c, t, g, unknown or other
  modified_base (437)..(437): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccaggtctggcctgacacagcctgcctccgtgtctgagactcctggacagtcatcaccatctcctgcactggaaccagcagtgacgttggtgcttatatatgtctctgttcaangcattcaggcagccgaccccgaaatcttaatttatgtagttctttcgtcgcctcgtacgggtttctagtcgtcttctccggctccgaagtctggcaacgacggcctccctgacctatctctagacctccaggctggaggacgaggctgacttattattgacagctcatactntagaatcaatgtattcacttgtctgttcggcggacgggaacctaggttcgacccgtcgttacgtcgaacgaacccg

SEQ ID NO: 387802 - DNA, 520 bp, Homo sapiens
  misc_feature: GZ8MTXP01D7IYC.39.39.D06.1.454.CMB.2.raw
  modified_base (303)..(303): a, c, t, g, unknown or other
  modified_base (314)..(314): a, c, t, g, unknown or other
  modified_base (320)..(320): a, c, t, g, unknown or other
  modified_base (329)..(329): a, c, t, g, unknown or other
  modified_base (426)..(426): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccagcagtgacattggtagtgataactatgtctctgtaccaacaatacccagggaacgccccaaatcatcatttangagtcaataancgcctnaggatttcngatcgtcttctctgctccaagtctggcaaacacgcctccctgaccatctactgggctccgagatggaagaccgaggggctgtaattatatgcagctnatatactgaaagtcaaagtgttatcccgtaagttggttcttagggttccggacgggaaggggtaaccaggttcgtaaccggttcgttaacgggg

SEQ ID NO: 387803 - DNA, 545 bp, Homo sapiens
  misc_feature: GZ8MTXP01BN4LZ.39.39.D06.1.454.CMB.2.raw
  modified_base (228)..(228): a, c, t, g, unknown or other
  modified_base (267)..(268): a, c, t, g, unknown or other
  modified_base (375)..(375): a, c, t, g, unknown or other
  modified_base (445)..(445): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgtccaacnncattcaggcagccgaccccgaaatcttaatttatgtagttctttcgtcgcctgtacggggtttctagtcgcttcgtccggctccaagtctggcaacacggcctcccngaccatctctagactccagctggaggacgaggctgacttattattgactagctacatactactgaaagtntaaagtggtaacttcctaagttggtcgttggttccggggacgggaacggggtaacctaaggttccgaacccggttacttacggtccgaacgtaaccccgg

SEQ ID NO: 387804 - DNA, 675 bp, Homo sapiens
  misc_feature: GZ8MTXP01CSFXW.39.39.D06.1.454.CMB.2.raw
  modified_base (266)..(266): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatatatgtctctgtccaacngcattcagcagcctaccccgaaattcttaaatttatggacggtttcctttccggtccggtcccttcgtacgggggttttcctaggttcgtcctttccgtcccgggtcttcccgaaagttcctcgggaccaaccgaccgggtccccttaccccgtacgtaccctacttcctcttaacgaccctaccgagggtcctaggaacgggacgaacgggtccttacggtaacctttaagtttaacgttcggactaacggtccttacgtaattaacgttaacgtaggtaaacgttacctaaaggttcggttaacttcccgtaacggttggtcgttcgggtttaccgggcgggttaacggggtaacccgtaaaggtttcggacccggttccgttacgggttccgaacggtaaccccgg

SEQ ID NO: 387805 - DNA, 503 bp, Homo sapiens
  misc_feature: GZ8MTXP01EMCV9.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagcgaccccgaaactcttaatttatgaggttctttcgtcggccctcgaggggtttctagtcgcttctccggctccaagtctgcaacacggcctccctgaccatctctagactccaggctggagacgaggctgacttattatgcagctcatatactgaagtcaaatggtaattccattggctggttcggcggagggaaccagttcgacctcgagtcaacgcccg

SEQ ID NO: 387806 - DNA, 503 bp, Homo sapiens
  misc_feature: GZ8MTXP01EOZTA.39.39.D06.1.454.CMB.2.raw
tcagtcgcactagtcacgaccggtgctcgatttagtgacatctcgcagttctttggggggtctcaggaggcagcgctctcaggacatctccaccatggtctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagcgccccgaaatcttaatttatgaggttctttcgcggccctcgacggggtttctagtcgcttctccggctccagtctggcaacacggcctccctgaccatctctagactccaggctgaggacaggctgacttattatgcagctcatatactgaagtcaaagtggtaattcccattggcttggttcggcggagggaaccagttcgaccgtcaggtcaagtcccg

SEQ ID NO: 387807 - DNA, 547 bp, Homo sapiens
  misc_feature: GZ8MTXP01DG7V7.39.39.D06.1.454.CMB.2.raw
  modified_base (230)..(230): a, c, t, g, unknown or other
  modified_base (245)..(245): a, c, t, g, unknown or other
  modified_base (254)..(254): a, c, t, g, unknown or other
  modified_base (269)..(270): a, c, t, g, unknown or other
  modified_base (293)..(293): a, c, t, g, unknown or other
  modified_base (300)..(300): a, c, t, g, unknown or other
  modified_base (426)..(426): a, c, t, g, unknown or other
  modified_base (464)..(464): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtncttataatntgtctctgtaccaannctatcagcagccgacctaaattnttaattngtacgttctttcgcgcctggtacgggttcagtctcttcgccgctcgaagtctagaccaacgccgtcctaccctgacctactctacgtacgacctcgaggctagggaagcgtagctagacttaattntgcagtctataatatactagtaatacaagttcgtaacnccgtagttgcgttgggttccggcgggaacgggtaacctaaggttccggtaacccgtcgttacgggtccgaaccgtaaccccgg

SEQ ID NO: 387808 - DNA, 530 bp, Homo sapiens
  misc_feature: GZ8MTXP01BA02A.39.39.D06.1.454.CMB.2.raw
  modified_base (226)..(226): a, c, t, g, unknown or other
  modified_base (267)..(267): a, c, t, g, unknown or other
  modified_base (367)..(367): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataatatgtctcctggttccaanagcattcaggcagccgaccccgaaatctttaatttatgtaggttctttcgtcggcctcgtacggggtttctagtcgcttctccggctcagtctggcaacncggcctccctgacctatctctacgactccgaggctgaggacgagctgacttattatgcagctcatatactagaactcaaagtggtaacttccgacttgggtccttggttccgggcggttagggaacctaagttcgacccgtcttacgggtccaacggaacccg

SEQ ID NO: 387809 - DNA, 536 bp, Homo sapiens
  misc_feature: GZ8MTXP01C07Y3.39.39.D06.1.454.CMB.2.raw
  modified_base (270)..(270): a, c, t, g, unknown or other
  modified_base (363)..(363): a, c, t, g, unknown or other
  modified_base (371)..(371): a, c, t, g, unknown or other
  modified_base (378)..(378): a, c, t, g, unknown or other
tcagtcgcactagtcacgaccggtgctcgatttagtgacatctcgcagtttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaangcattcaggcagccgaccccgaaatcttaatttatgagttctttcgcgcctgtacggggtttctagtcgtcttctccggctcagtctggcacncgcctccngacatcnctagactcaggctgaggacgaggctgacgttattattgcagctcattactactgaagtcaaattggtaacttccgagttggtacttggtttaccgggcggacggggtaaccctaagggtttcgacccggttcgttaacgggttccaacggtaaccccg

SEQ ID NO: 387810 - DNA, 533 bp, Homo sapiens
  misc_feature: GZ8MTXP01EZG3H.39.39.D06.1.454.CMB.2.raw
  modified_base (229)..(229): a, c, t, g, unknown or other
  modified_base (255)..(255): a, c, t, g, unknown or other
  modified_base (414)..(414): a, c, t, g, unknown or other
  modified_base (449)..(449): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggaacagggtcctgggcccagtctggcctgacacagcctgcctccgtgtctgagactcctggacagtcgatcaccatctcctgcactggaaccngcagtgacgttggtgcttataattangtctcctggttccaacagcattcaggcagccgaccccgaaatcttaatttatgtaggttctttcgtcggccctcgaggggtttcctagtcgcttctccggctccaagtctggacaacaccggcctcctgacctatctctagactccaggctgaggacgngctgactattattgcagctcatatactgtaacgtnaagttggtaatcccaagtcggcgttggttcgggcggaggggaccctaaggttcgaaccgtccgtaggttacaacgcccgaacgg

SEQ ID NO: 387811 - DNA, 600 bp, Homo sapiens
  misc_feature: GZ8MTXP01AIHHJ.39.39.D06.1.454.CMB.2.raw
  modified_base (229)..(229): a, c, t, g, unknown or other
  modified_base (268)..(268): a, c, t, g, unknown or other
  modified_base (304)..(304): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgtccaacngcattcaggcagccgaccccgtaaatcttaaatttntgtaggttctttcgcgtccctgtacgggtttctagtcgtcttcgtccgctccaagtctggacaacgcggccctcctcgacctatcctactacgactccgaggtcctaggacggacgacggctaggaactttagtttacgttcgacgtacgtcctactaattacgtactagaaacgttacaaagttcggtaacttccgtacgttggtccgttggttaccgggcgggaacgggtaacccgttaaacggtttccggaacccggttacccggttagggtcccgttaacggtaacccccgg

SEQ ID NO: 387812 - DNA, 601 bp, Homo sapiens
  misc_feature: GZ8MTXP01DQMMV.39.39.D06.1.454.CMB.2.raw
  modified_base (268)..(268): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgttccaacngcattcaggcagccgaccccgtaaatctttaaatttatgtagttctttcgcgccctcgtacggggtttctagtcgtctttcgtcccggctcccgaaagtctgggaccaaaccgcgggtcccttcccctgaccctattcctactacgaccttccgaggtcctaggaacggacgtaaggcttagaacgttatttacttgacagtctactataagtactgaaagtcaaagtggtaacttccgaacgttggccttgggtttcgggccgggttaaaggggtaacccttaaaagggttcgtaacccggttccgttaacgggtccaaccgggtaaccccg

SEQ ID NO: 387813 - DNA, 505 bp, Homo sapiens
  misc_feature: GZ8MTXP01B9LXQ.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctgttccaacagcattcaggcagcgaccccgaaatcttaattatgaggtctttcgcgcctcgtacgggtttcagtcgtctctccggctcaagtctggcaacacgcctcctgaccatctctagactcaggctgaggacgaggtctgactattatgacagctcatatactagaatcaatggtacttctacgttggctggttcggcggacgggaacctaagttcgaccgtcgttacggtcaacgaacccg

SEQ ID NO: 387814 - DNA, 677 bp, Homo sapiens
  misc_feature: GZ8MTXP01CW34Y.39.39.D06.1.454.CMB.2.raw
  modified_base (228)..(228): a, c, t, g, unknown or other
  modified_base (385)..(385): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgacgttggtgcttataatatgtctctgttccaaacagcattcaggcagcgaccccgaaatcttaattatgagttcttcgtcgcctcgtacgggtttctagtcgtcttcctccggctccaagtctcgggcaaccgacggccctccctgacctntacctctaacgacctaccgaagggtcctggaacggaccgaggccttaggaaccgtttatttaacgtttgacgtaacgtccttactaaattaagttaaccttaagggtaaaaccgttctaaaacggtttaaggggttaaaccttaccccgtaaacgttggggtccccgtttaaggggttttcccgggggaccgggggaaacgggggtaaaccccgttaaaaggggttttccggaaacccccgggttttaccggttaaccgggggtttaacccttaaaacgggtaaccccccgg

SEQ ID NO: 387815 - DNA, 518 bp, Homo sapiens
  misc_feature: GZ8MTXP01A1GSG.39.39.D06.1.454.CMB.2.raw
  modified_base (368)..(368): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagcgaccccgaaatcttaatttatgaggttctttcgtcggccctgtacggggtttctagtcgcttctccggctcaagtctggcaacncggcctccctgacctatctctagactccaggctagaggacgaggctgacttattattgcagctcatatactagaagtcaaatggtaacttcacgttggcgtggttcggcggagggaaccaagttcgaccgtcttaggtcaacgtaacccg

SEQ ID NO: 387816 - DNA, 555 bp, Homo sapiens
  misc_feature: GZ8MTXP01CRFQ4.39.39.D06.1.454.CMB.2.raw
  modified_base (228)..(228): a, c, t, g, unknown or other
  modified_base (267)..(267): a, c, t, g, unknown or other
  modified_base (431)..(431): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgttcaacngcatcaggcagccgaccccgaaatcttaatttatgtaggttctttcgtcgcctgtacggggtttctagtcgtcttctccgctcaagtctggcaacgacggcctccctgaccatctctacgactcaggctaggagacgaggctagacttaagttattgctagctntatatactagaagtcaaagttggtaattccctagttcggtacgttgggttaccgggcgggaaacgggtaacccgtaaaggtttccggaacccggttccgttacgggttccaacgggtaaccccg

SEQ ID NO: 387817 - DNA, 586 bp, Homo sapiens
  misc_feature: GZ8MTXP01CTHTR.39.39.D06.1.454.CMB.2.raw
  modified_base (268)..(268): a, c, t, g, unknown or other
tcagtcgcactagtcacgaccggtgctcgatttagtgacatctcgcagttctttgggggggtctcaggaggcagcgctctcaggacatctccaccatggcctggactctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctggtccaacngcattcaggcagccgaccccgtaaatctttaatttagtgacgttctttcgtccgcccttcgtacggggtttctaggttcgctttcctcccgggtctccgaaagtcctagggaccaacgaccggtccctcccgtagaccctattcctctacgacctccgaggctaggaggacgaggctagacttattattcgactagctacattactactgtaagtctaagtcggtacttcccgacgttggtccgttgggttccgggcgggttacggggtaacctaaagggtttcgacccggttacgttacggtccaacggtaaccccg

SEQ ID NO: 387818 - DNA, 520 bp, Homo sapiens
  misc_feature: GZ8MTXP01A0WDB.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctggttccaacagcattcaggcagccgaccccgaaatctttaaatttatgtaggttctttcgtcggccctcgtacggggtttctagtcgtcttctccggctccaagtctgggccaacaccggcctccctgaccatctctagactccgagctgagacgagctgacttatattgcagctcatatactagaagtcaatggtacttcacgttggctggttcgggcggagggtaaccagttcgaccgtcgttaggtcaacgaacccg

SEQ ID NO: 387819 - DNA, 533 bp, Homo sapiens
  misc_feature: GZ8MTXP01ADHEP.39.39.D06.1.454.CMB.2.raw
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgttccaangcattcaggcagcgccccgaaattcttaatttatgtaggttctttcgtcggccctcgtacggggtttcagtcgtcttcgtccggctccaagtctggcaacgcggcctccctgaccatcgtctagactccagctgaggacgaggctgacttattatgcagctcatatactgaaagtcaaagtggtaattcccagttggccgttgttccgggcgggttacggggaacctaggttcgaaccgtcccgttaggtccgaacgaaccccgg

SEQ ID NO: 387820 - DNA, 508 bp, Homo sapiens
  misc_feature: GZ8MTXP01BZ8OF.39.39.D06.1.454.CMB.2.raw
  modified_base (454)..(454): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagccgaccccgaaatcttaaatttatgtaggttctttcgtcggccctcgtacggggtttctagtcgcttctccggctccaagtctggcaacacggcctccctgaccatctctagactccagctgaggacgaggctgacttattattgcagctcatatactgaagtcaaatggtancacttggctgttcggcggagggaaccaagttcgacgtcttagtcaagtaacccg

SEQ ID NO: 387821 - DNA, 547 bp, Homo sapiens
  misc_feature: GZ8MTXP01EGYDF.39.39.D06.1.454.CMB.2.raw
  modified_base (228)..(228): a, c, t, g, unknown or other
  modified_base (380)..(380): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccngcagtgacgttggtgcttataatatgtctcctgttccaacagcattcaggcagccgaccccgtaaacttcttaaatttatgtagttctttcgtcgccctgtacgggtttctagtcgtcttcgtccgctccaagtctggcaacacggcctccngaccatctctagactccgaggctgacggacgaggcttagacttattattgctagctcatatactgaatcaatgtaacttccgaacttgggtacttgggttccgggcgggacggggtaaccctaaggtttcggaaccccgttcgttacggttcgaacggtaaccccgg

SEQ ID NO: 387822 - DNA, 610 bp, Homo sapiens
  misc_feature: GZ8MTXP01ELC1G.39.39.D06.1.454.CMB.2.raw
  modified_base (246)..(246): a, c, t, g, unknown or other
  modified_base (253)..(254): a, c, t, g, unknown or other
  modified_base (265)..(266): a, c, t, g, unknown or other
  modified_base (270)..(270): a, c, t, g, unknown or other
  modified_base (292)..(292): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagactccgtggacagtcgatcaccatctcctgcactggaaccagcagtgacgttgtgnttatatnntctctgtcaanncatnagcagccacctaaatcttaatntgtagtcttcgcgtcctgtacgggttctagtcgtcttctccgctccgtagtcgtacgaccaaccgaccggtccctcccgtacgtaccctactcctactacgaccttaccgacggtacctaggacggacgtagggtactaggtaacttaagtttacttcgactacgtccttacaattaactacgtaggtaaactacgtaaagttcggttacttaccgtacgttcgggtcgtttcgggttacgggccggggaacgggttaaccgtaacgggtttccggtaacccggttaccgttaacgggttcccgaacgtaaccccggg

SEQ ID NO: 387823 - DNA, 541 bp, Homo sapiens
  misc_feature: GZ8MTXP01EMLOQ.39.39.D06.1.454.CMB.2.raw
  modified_base (242)..(242): a, c, t, g, unknown or other
  modified_base (271)..(271): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngtcttaataatatgtctcctgttccaaangctatcaggcagccacccgtaaattcttaattatgtagttctttcgcgcctgtacgggtttcagtcgtcttcgtccgctcaagtctggacaaacgcggtccctcctacgacctatctactagactccgaggctagaggacgagctagacttattagtgaccagtctctataatatagtaagtactaataagtattctacgttcgtcgtcggttcggttcgggacgggaacgtaacgtaacgtaccgtaccgttacgtcgaacgaacccgg

SEQ ID NO: 387824 - DNA, 574 bp, Homo sapiens
  misc_feature: GZ8MTXP01EKD6E.39.39.D06.1.454.CMB.2.raw
  modified_base (277)..(277): a, c, t, g, unknown or other
  modified_base (523)..(523): a, c, t, g, unknown or other
  modified_base (551)..(551): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaagggctgagttggattggtagaaataaagtgaggaccgggggacaccaactacaangcgtccctgagggtcagtcaccatatctgcagacaaagtccaaagaacccacttcctccctgacggctcgacccctctgtcgacccgccgacgactcggcatactattattgtgacgtagtagttttgcgtaggtattcggttggggcgttatcggacgtcgtggggtacaagggtctacgacggtcagtcgtcctcctcgacgcctaccaccgaacgggccccaagttccggttcccttccccgnggcccgtcccgttcgccttccgaaggcnccacccgtccgagcgcgaaccgg

SEQ ID NO: 387825 - DNA, 519 bp, Homo sapiens
  misc_feature: GZ8MTXP01D37M0.39.39.D06.1.454.CMB.2.raw
  modified_base (269)..(269): a, c, t, g, unknown or other
  modified_base (436)..(436): a, c, t, g, unknown or other
  modified_base (456)..(456): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttaataatatgtctctgttccaangcattcagcagccaccccgaaatcttaatttatgtagtctttcgcggccctcgtacggggtttctagtcgtcttctccggctccaagtctggaccaacgaccggcctccctgacctatcctctacgactccgaggctgaggacgaggctagactattatgcagcctnatatctgaatcaatggtaanccgacttggctggttcggcggacggaacctaaggttcgaccgtcgttacggtcaacgaacccg

SEQ ID NO: 387826 - DNA, 581 bp, Homo sapiens
  misc_feature: GZ8MTXP01EBVPZ.39.39.D06.1.454.CMB.2.raw
  modified_base (229)..(229): a, c, t, g, unknown or other
  modified_base (253)..(253): a, c, t, g, unknown or other
  modified_base (267)..(267): a, c, t, g, unknown or other
  modified_base (465)..(465): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatntgtctctgtccaangcatcaggcagccgaccccgtaaatctttaaatttatgtaggttctttcgtcggcccttcgtacgggtttctagtcgtcttcgtccggctccgaagtccgtaggaccaacgaccggtccctccctagaccctatctactagacctcccgtaggcctagggaacggacgaggctagtaacttaattagtgacagcctanattatactgtaactcaaagtcgtattcccgagttggtcttcgggttccgggcgggttaacgggtaaccctaaaggttcggaacccgttccgttaagggttcccaacggtaaccccg

SEQ ID NO: 387827 - DNA, 531 bp, Homo sapiens
  misc_feature: GZ8MTXP01DGI6R.39.39.D06.1.454.CMB.2.raw
  modified_base (227)..(227): a, c, t, g, unknown or other
  modified_base (242)..(242): a, c, t, g, unknown or other
  modified_base (253)..(253): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactgaaccngcagtgacgttggtntacttataatntgtctctgtccaanagctatcgaggcacgccgacccctaaattctttaatttatgacgttcttcgtcgcctgtacgggttcagtctctctccgctcagtctgacaacgcgcctccctgacctatctcacactcgagctaggacggacgaggctagacttattagtgctagtctactataatactagaactcaagttgtaacttccgattcgggcttgggttcgggcgggttacggaacctaaggttcgaacccgtcgttaaggtccgaacgtaacccg

SEQ ID NO: 387828 - DNA, 521 bp, Homo sapiens
  misc_feature: GZ8MTXP01APP7E.39.39.D06.1.454.CMB.2.raw
  modified_base (270)..(270): a, c, t, g, unknown or other
  modified_base (304)..(304): a, c, t, g, unknown or other
  modified_base (366)..(366): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacngcattcaggcagcgaccccgaaatcttaatttangtagtctttcgtcggccctgtacggggtttcagtcgtcttctccggctccagtctggcaacncggccctccctgaccatctctagacctaccgagctggacggacgaggctgacttattatgcagctcaattatactagaagtcaaatggtaacttccacgttggtctggttcggcggttacggaacctagttcgaccgtcgttaggtcaacgcccg

SEQ ID NO: 387829 - DNA, 509 bp, Homo sapiens
  misc_feature: GZ8MTXP01C6Z2P.39.39.D06.1.454.CMB.2.raw
  modified_base (229)..(229): a, c, t, g, unknown or other
  modified_base (464)..(464): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacgttggtggttataactatgtctcttggtaccaacatcaccaggacaaagtccccaaatgatgatttatgagtcactaaacgcctcaggggtttcctaatcgcttctctgctccaagtctggcaacacggcctccctgaccatctctgggctcaggctgacggacgaggctcgttctattattgcagctcatatacaagcattatctacgttgggtcgttcgggcggngggacccgacttcggaaccgtcgttgtcacgccctaagcgtcccg

SEQ ID NO: 387830 - DNA, 549 bp, Homo sapiens
  misc_feature: GZ8MTXP01DQA99.39.39.D06.1.454.CMB.2.raw
  modified_base (451)..(451): a, c, t, g, unknown or other
tcagtcgcactagtcacgaccggtgctcgatttagtgacatctcgcagttctttggggggggtctcaggaggcagcgctctcaggacatctccaccatggcctgggctctgggctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagccgaccccgaaactctttaaatttatgtagttctttcgtcggccctcgtacggggtttctagtcgtcttctccggctccgaagtcctggacaacacggtcctccctgaccatctactacgactccaggctagacggacgaggctagacgttatttattgcagcctnatatactgtaagtcaatggtacttccaacgttggtaccttggttcgggcgggaagggtaacctaaggttcgaacccgtcgttacggtcaacgaacccg

SEQ ID NO: 387831 - DNA, 503 bp, Homo sapiens
  misc_feature: GZ8MTXP01BAXW6.39.39.D06.1.454.CMB.2.raw
  modified_base (227)..(227): a, c, t, g, unknown or other
  modified_base (253)..(253): a, c, t, g, unknown or other
tcagtcgcactagtcacgaccggtgctcgatttagtgacatctcgcagttctttggggggtctcaggaggcagcgctctcaggacgtctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattangtctcctggttccaacagcattcaggcagcgccccgaaatcttaatttatgaggttctttcgtcggccctgtaggggtttcctagtcgcttctccggctccaagtctggcaacacggcctcctgaccatctctagactcagctgagacgagctgactattattgcagctcatatactgtaagtcaatggtaactcatggctggttcggcggaggaccaagttcgaaccgtcgtaggttcaagcccgaagg

SEQ ID NO: 387832 - DNA, 550 bp, Homo sapiens
  misc_feature: GZ8MTXP01DALTF.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagccccagggaagggctgagttggattggtgaataaatgagaccgggggcaccgaactacaatgcgtccctcaggggtcgagtcaccatatctgcagacaagtccaagaacccacttctccctgaggctgacccctctgtgaccgccgcggactcggccatatattattgtgcgagtagtttttgcaggatcgttggggcgtatcgacgtctggggtcaagggagtcgacggtcagtcgtctcctcacgcctccaccgaacgggccccaatccgggttctttccccccgttggcccgtcccttcgccttcccgaaggacgcaccctccgagaacgcgaaccg

SEQ ID NO: 387833 - DNA, 664 bp, Homo sapiens
  misc_feature: GZ8MTXP01AYIN0.39.39.D06.1.454.CMB.2.raw
  modified_base (230)..(230): a, c, t, g, unknown or other
  modified_base (243)..(243): a, c, t, g, unknown or other
  modified_base (245)..(245): a, c, t, g, unknown or other
  modified_base (253)..(253): a, c, t, g, unknown or other
  modified_base (255)..(255): a, c, t, g, unknown or other
  modified_base (266)..(268): a, c, t, g, unknown or other
  modified_base (271)..(271): a, c, t, g, unknown or other
  modified_base (294)..(294): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacgttgntnttataatntntctctgtcaannnatnagcagccaccctaatcttaattntgtgttcttcgtcgcctgtacgggtttcagtcgtcttcgtccgtctccgtagtcctaggaccaaccgtccggtcccttacccgtacgaaccctactccttacgttaacgacccttaccgacgggtccgttagggaacgggaccgagggtaccttaggtaaccttaagtttacttacggcctaagtccttacgtaagttaaacttaccgtaaggtaaacgttaccgtaaagttcggttaacttccccgtaaggttcgggttaccgttcggggtttaccggggaccggggttaaacgggtaacccgtaacgggtttaacccggtaaccccggttacggttaccgggtaacccgttaaccggtaacccccggg

SEQ ID NO: 387834 - DNA, 573 bp, Homo sapiens
  misc_feature: GZ8MTXP01AFYKV.39.39.D06.1.454.CMB.2.raw
  modified_base (229)..(229): a, c, t, g, unknown or other
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctggtccaacngcattcaggcacgccgaccccgtaaattctttaatttatggtacggttctttcgtcggtcccttcgtacgggggtttctagtcgtcttcgtcccggctccaagtcctggaccaacgcggcctccctgacctatctctacgactccgaggctagacggacgaggctagacgttattagttgcacgctcaattactactaggtaatactaagtcggtacttcgaacgttcggtacgttgggttccgggcgggttaacggaaccctaaggtccgtaccggttccgttaggtccgaacggtaaccccg

SEQ ID NO: 387835 - DNA, 538 bp, Homo sapiens
  misc_feature: GZ8MTXP01CKR36.39.39.D06.1.454.CMB.2.raw
  modified_base (227)..(227): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacagcatttcaggcagccgaccccgaaactcttaatttatgtaggttctttcgtcggcccttcgtacggggtttctagtcgtcttccgtccggctccaagtcctggacaacacggccctccctgacctatctctagactccagctgagacgaggctgacgttattagttgctagctacatatactgaagtcaattggtaattcccagttggcttgttcgggcggttacgggaaccctaaggttcgaaccgtcgttaggtcgaacgtaacccg

SEQ ID NO: 387836 - DNA, 586 bp, Homo sapiens
  misc_feature: GZ8MTXP01CUUJI.39.39.D06.1.454.CMB.2.raw
  modified_base (229)..(229): a, c, t, g, unknown or other
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctgttccaanagcattcaggcagccaccccgaaatcttaatttatgagttctttcgtcgcctcgtacggggtttctagtcgtcttctcccggctccaaagtctgggaccaacgacggtccctccctgacccatctctacgacctccaggctaggagacgaggctagacttattattgcagctacattaatactaggaaatccgtaaattggtaacttcctaacgttcggtacgttcggtttacggggccgggttaacggggtaaccccgtaaaagggtttcggaaccccggttaccgttacgggttaacccgaacggtaacccccgg

SEQ ID NO: 387837 - DNA, 511 bp, Homo sapiens
  misc_feature: GZ8MTXP01DUEKW.39.39.D06.1.454.CMB.2.raw
  modified_base (226)..(226): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctctgcactggaaccngcagtgacgttggtgcttataatatgtctcctggttccaaacagcattcaggcagcgaccccgaaatctttaatttatgtagttctttcgtcgccctcgtacggggtttctagtcgcttcgtccggctccgaagtctggcaacacggcctccctgaccatctctacgactcaggctgagacgagctgactattattgcagctcatatactgaaagtcaaatgtattccacgttggctgttcggcgttagggaacctaagtcgacgtccttaggtcaacgaacccg

SEQ ID NO: 387838 - DNA, 532 bp, Homo sapiens
  misc_feature: GZ8MTXP01ECN6B.39.39.D06.1.454.CMB.2.raw
  modified_base (229)..(229): a, c, t, g, unknown or other
  modified_base (252)..(252): a, c, t, g, unknown or other
  modified_base (265)..(265): a, c, t, g, unknown or other
  modified_base (328)..(328): a, c, t, g, unknown or other
  modified_base (333)..(333): a, c, t, g, unknown or other
  modified_base (383)..(383): a, c, t, g, unknown or other
  modified_base (392)..(392): a, c, t, g, unknown or other
  modified_base (422)..(422): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataatntgtctctgtccanagcatcagcagccacccgaaatcttaattatgtagtctttcgcgcctgtacgggttctagtcncttcnccgctcgatctggcacgacggcctcctcgaccatctctagactcgagtcngacggacgnggctgtaacgttattagttgactagtcctntaatttgactaaatcgaagtgaaggtcttatcgttcgttacgggaaaggttcgggaacccttaggtctagtcggttaccctagggttacctaacgaacccgtaaacccgg

SEQ ID NO: 387839 - DNA, 637 bp, Homo sapiens
  misc_feature: GZ8MTXP01ADG2I.39.39.D06.1.454.CMB.2.raw
  modified_base (228)..(228): a, c, t, g, unknown or other
  modified_base (252)..(252): a, c, t, g, unknown or other
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgacgttggtgcttataatntgtctctgtaccaacngtcattcaggcacgcccgacccgtaaattctttaatttatggtacgttctttcgtccggccttcgtacgggtttcagtccgtcttcgtcccggctccgaagtctaggaccaaccgaccggccctccctacgaccctatcctacgtacgaccttccgaaggtcctagggaacgggacgtaagggcttaggaactttagtttagttcggactacgtctactaattaactactaggtaaattaccaagttcggtaaaccttccgaacgttcgggtcgttcggggttacccggggcgggttaaacgggtaacccgtaagggttaacccggtaacccgggttcccgttaacgggtccgaacccggtaaccccgg

SEQ ID NO: 387840 - DNA, 638 bp, Homo sapiens
  misc_feature: GZ8MTXP01CY8Y4.39.39.D06.1.454.CMB.2.raw
  modified_base (229)..(229): a, c, t, g, unknown or other
  modified_base (244)..(244): a, c, t, g, unknown or other
  modified_base (253)..(253): a, c, t, g, unknown or other
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtncttataatntgtctctgtaccaangcatcaggcacgccgacccctaaattcttaatttagtgtacgtttctttccggtcgtcctcggtacggggtttcagtcgtcttcgcccggctccgaagtctaggaccaacgccgccctaccctgacctatctactacgacctacgaggtctagggaacggacgtacggacttacggtaaactttagtttacgttacggacctaacggtcctaacctaagttaaacctaacgttaagtaaacggttacaaaggttaacggtaaccttccgtaacggttcgggttacgttcgggttaccggggcggggttaacgggtaaccgtaagggttccggtacccggtacgttacggtaaccgaacccggtaacccgg

SEQ ID NO: 387841 - DNA, 554 bp, Homo sapiens
  misc_feature: GZ8MTXP01EAMRO.39.39.D06.1.454.CMB.2.raw
  modified_base (386)..(386): a, c, t, g, unknown or other
  modified_base (510)..(510): a, c, t, g, unknown or other
  modified_base (533)..(533): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaaggggctgagttggattggtagaaataaatgagaccgggggcacaactacaatgcgtccctcgaggggtcgagtcaccatatctgcagacaaagtccaaagaacccacttctcctgaggctcgacccctctgtcgaccgccgcgactcggccatactattattgngcgagtagttttgctaggattcgttggggcgttatcggacgttcgtggggtacgaagggatcgtacggtcagtcgtctcctcgacgcctcccacgacgggcccaagtccggttcccttccccgngccgcccttgccttccgaaggcncctaccgccgagcgcgaaccg

SEQ ID NO: 387842 - DNA, 500 bp, Homo sapiens
  misc_feature: GZ8MTXP01BZPWO.39.39.D06.1.454.CMB.2.raw
  modified_base (228)..(228): a, c, t, g, unknown or other
  modified_base (306)..(306): a, c, t, g, unknown or other
  modified_base (447)..(447): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtggttataactatgtctcttggtaccaacatcacccaggacaaagtccccaaactgatgatttangaggtcactaaacgcctgaggggtttcctaatcgtcttctctggctcaagtctggcaacacggcctccctgaccatctctagactccaggctgaggacgaggctgactattatgcagctcatatactgaatcaatggtaancacttggctgttcggcggaggaacctagtcgaccgtcgttagtcaagaacccg

SEQ ID NO: 387843 - DNA, 541 bp, Homo sapiens
  misc_feature: GZ8MTXP01A3YLF.39.39.D06.1.454.CMB.2.raw
  modified_base (226)..(226): a, c, t, g, unknown or other
  modified_base (264)..(264): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcatggaaccngcagtgacgttggtgcttataatatgtctctgtccaangcatcaggcagccgaccccgaaattcttaatttatgtaggttctttcgtcgcccttcgtacggggtttctagtcgtcttctccgctcgaagtctggcaacgcggccctccctgaccctatcctactacgacctccgaggctgaggacgaggctagacttattatgacagctcattatactagaagtcaaagtggtaacttccgtagttggcttggttcgggcgggaacgggtaaccctaaggttcgaacccgtcgttacggtccgaacggtaacccg

SEQ ID NO: 387844 - DNA, 582 bp, Homo sapiens
  misc_feature: GZ8MTXP01BVN3C.39.39.D06.1.454.CMB.2.raw
  modified_base (268)..(268): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgtactggaaccagcagtgacgttggtgcttataattatgtctctgtaccaangctattcagcagccgaccccgaaattcttaattatgaggttctttcgtcgcctgtaggggtttcctagtcgtcttcctcccggactccaagtctagggcctaaaccgaccggtccctccctgaccctatcctacgtagaccttccgaggcctaggacgggacgagggtcctaggtaccttatttaagttggaccagtcctcattatacgtgtaacgtcaaagttggtaactccacgttgttccgtgggttccgggacgggacgggaccgttaacgtggaacccgttcgtacggttacgaaccgcccgtaacggg

SEQ ID NO: 387845 - DNA, 546 bp, Homo sapiens
  misc_feature: GZ8MTXP01AQHB6.39.39.D06.1.454.CMB.2.raw
  modified_base (268)..(268): a, c, t, g, unknown or other
  modified_base (443)..(443): a, c, t, g, unknown or other
  modified_base (498)..(498): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcacatctcctgcactggaaccagcagtgacgttggtgcttataatatgtctcctggtccaaacngcattcaggcacgccgaccccgaaattcttaaatttagtgtacgttcttcgtccgtcctgtacgggtttctagtcgtctccgtccgctcagtctgacaacgcgcctccctagaccatctactacgactcgagtctggacgacgagtctacgtacttattagttcgactagcctanaattactactagaacgttcaagttgtaacttccgaacgttgtcttgggttccggnggttacggaactaaggttcgaccgtcgttacggtcgaaccgtaacccg

SEQ ID NO: 387846 - DNA, 592 bp, Homo sapiens
  misc_feature: GZ8MTXP01CGEEJ.39.39.D06.1.454.CMB.2.raw
  modified_base (229)..(229): a, c, t, g, unknown or other
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgttccaanagcattcaggcagccgaccccgaaatcttaaatttatgtaggttctttcgtcggccctgtacggggtttctagtcgtcttcgtccggctccaagtctggcaacacggtcctccctgaccatctctacgactccgaggctaggaggacgaggctagacgttattagttgaccagtctcaattatactagtaactacaaagttcggttaaacttcccgtaacgttgggtccgttgggtttccggggcgggttaacggggtaacccctaaagggtttccggaaccccggttaccgttacgggttaacccgaaccgggtaacccccgg

SEQ ID NO: 387847 - DNA, 552 bp, Homo sapiens
  misc_feature: GZ8MTXP01DJTCB.39.39.D06.1.454.CMB.2.raw
  modified_base (228)..(228): a, c, t, g, unknown or other
  modified_base (361)..(361): a, c, t, g, unknown or other
tcagtcgcactagtcacgaccggtgctcgatttagtgacatctcgcagttctttggggggggtctcaggaggcagcgctctcaggacatctccaccatggcctggactctgctgctcctcaccctcctcactcagggcacagggtcctgggcccagtctggcctgacacagcctgcctccgtgtctgagactcctggacagtcgatcacatctcctgcactggaaccngcagtgacgttggtgcttataatatgtctctggttccaacagcattcaggcagccgaccccgaaatcttaatttatgagttctttcgcgcctgtacgggtttctagtctctctccggctcagtctaggcaacncggcctcctgaccatctctagactccaggctgaggacgaggctgacttattattgctagctacattaatacgtagtaaagtcaaagttggtaacttccgtacgttgggttcgtcgggtttacgggcggggttaacgggtaacccgtaaaggtttcggacccgttcgttaacgggttccaacggtaaccccg

SEQ ID NO: 387848 - DNA, 510 bp, Homo sapiens
  misc_feature: GZ8MTXP01AWYZ7.39.39.D06.1.454.CMB.2.raw
  modified_base (224)..(224): a, c, t, g, unknown or other
  modified_base (265)..(265): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctctcactcagggcacagggtcctgggcccagtctggcctgacacagcctgcctcgtgtctgagactctggacagtcgatcaccatctcctgcactggaaccngcagtgacgttggtgcttataatatgtctcctggttccaanagcattcaggcagccgaccccgaaactctttaaatttatgaggttctttcgtcggccctcgaggggtttcagtcgcttctaccggctccaagtctggcaacacggcctccctgaccatctctagctccagctgagacaggctgactattatgcagctacatatactgaaagtcaaatggtaattccattggctggttcggcggagggaacctaaggttgaccgtcttaaggtcgaacggaacccg

SEQ ID NO: 387849 - DNA, 570 bp, Homo sapiens
  misc_feature: GZ8MTXP01ET35I.39.39.D06.1.454.CMB.2.raw
  modified_base (229)..(229): a, c, t, g, unknown or other
  modified_base (272)..(272): a, c, t, g, unknown or other
tcagtcgcactagtcacgaccggtgctcgatttagtgacatctcgcagttcgtttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccngcagtgacgttggtgcttataatatgtctctggttaccaaacngcattcaggcacgcccgaccccgaaattctttaatttatgtagttctttcgccgcctcgtacggggtttctagtcgtcttccgtccgctccgaagtcgtggacaaacgccggtcctccctgacctatctactacgacttccgagtctagacggacgagctagtacttattatgacagtctcatatacgtagtaacgtcaagtcgtacttccgtaacgttggtcgttgggttccgggcgggaacgggtaaccgtaaggttccggacccggttaccgttagggttccaacggtaaccccg

SEQ ID NO: 387850 - DNA, 590 bp, Homo sapiens
  misc_feature: GZ8MTXP01CQYSN.39.39.D06.1.454.CMB.2.raw
  modified_base (225)..(225): a, c, t, g, unknown or other
  modified_base (264)..(264): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcacctctcactcagggcacagggtcctgggcccagtctggcctgacacagcctgcctccgtgtctgagactcctggacagtcgatcacatctcctgcactggaaccngcagtgacgttggtgcttataatatgtctctgtccaacngcatcaggcagccgaccccgaaattctttaaatttatagaggtttcctttacgtccggtcccttcgtaacggggtttcctagtccgtccgtttccgtcccgggaccttccgtaaagttccgtacgggacccaaaaccggtccgggtcccctcccgtacgaccctatcctactacgactaccagggtcctaggacggacgaggcttacgaacttattaactgactagtctacaattatactgaagtcaagttgtacttccgattggacctggttcgggacgacggtaacaaaggtttcgaacccgtcgacgttccgaacgaacccgg

SEQ ID NO: 387851 - DNA, 502 bp, Homo sapiens
  misc_feature: GZ8MTXP01CA8IR.39.39.D06.1.454.CMB.2.raw
  modified_base (271)..(271): a, c, t, g, unknown or other
  modified_base (359)..(359): a, c, t, g, unknown or other
  modified_base (367)..(367): a, c, t, g, unknown or other
  modified_base (374)..(374): a, c, t, g, unknown or other
  modified_base (403)..(403): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacngcattcaggcagcgccccgaaatcttaatttatgaggttctttcgtcggcctcaggggtttcagtcgcttctccgctcagtctgcacncgctcctnaccatcnctagctccaggctgagacgaggctgactnttattgcagctcatatactgaagtcaaattggtaattccacgttggcttggttcggcggagggaacctaaggttcgaccgtcgttaggtccaagtcccg

SEQ ID NO: 387852 - DNA, 620 bp, Homo sapiens
  misc_feature: GZ8MTXP01BTP7N.39.39.D06.1.454.CMB.2.raw
  modified_base (273)..(273): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtcggaaccagcagtgacgttggtgtcttataatatgtctctggttaccaanagctattcaggcacgccgaccccgtaaattctttaaatttagtggtacggttctttacggtcggtcccttcgtacggggtttctaggtcgtcttcgtcccggctccgaagttcgtacgggaccaaccgtacccgggtcccctccccgtacgaacctacttcctacgtacgaccttacccgagggtcctaggacggacgaggtactagtacttatttattcgctagctcattatactagtaagtacaagttggtaacttccgtacgttgggtcgttcgggttccgggcggacgggtaaccctaaggttccggaccggttccgttaacgggtccgaacggtaaccccgg

SEQ ID NO: 387853 - DNA, 648 bp, Homo sapiens
  misc_feature: GZ8MTXP01C2XZS.39.39.D06.1.454.CMB.2.raw
  modified_base (282)..(282): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccagctagtcgacggttggtgtacttaataatattgtccttccgtggttaccaanagtctattcgaggcacgcccgaacccccgtaaattctttaatttagtggtacgtttctttccgtcgtcccgttcgtacggggtttctacgtcgtctttccgtccggtctccgaagttctagggaccaacgaccggtccctccctacgacctattctactagaccttaccgaggtctagggacggaacgaggtctagtactttaattagttcgacctaagtcctactattaactaccgttagtaaagtccgtaaagttaacggtacttacccgtagttggttccgtcggggttacggggcggaaaacggggtaaccctaaagggtttccggaacccgttcgacggttaaccgaaccggtaaccccgg

SEQ ID NO: 387854 - DNA, 581 bp, Homo sapiens
  misc_feature: GZ8MTXP01BSEIK.39.39.D06.1.454.CMB.2.raw
  modified_base (229)..(229): a, c, t, g, unknown or other
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgttccaangcattcaggcagccgaccccgtaaacttctttaaatttatgtacggttctttcgtcggccctcgtacggggtttctagtcgtcttcgtccggctccgaagtctggccaaccgaccggccctccctgaccctatcctctacggaccttccgaggtctaggaacgggtacgaggtctagaaccttatttaacgttcgactaacgctactaattactactagtaagtcaaagttcggtaacttccgtacgttggtcgttcggttacggcgggttaacggaactaggttcgaccgtcgttaggtcgaacgtaacccg

SEQ ID NO: 387855 - DNA, 565 bp, Homo sapiens
  misc_feature: GZ8MTXP01AOJDJ.39.39.D06.1.454.CMB.2.raw
  modified_base (229)..(229): a, c, t, g, unknown or other
  modified_base (272)..(272): a, c, t, g, unknown or other
  modified_base (376)..(376): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataatatgtctcctggttccaacngcattcaggcaggccgaccccgtaaactctttaatttatgtaggttctttcgtcggccctcgtacggggtttctagtcgtcttcgtccggctcagtctgcaacncggcctccctcgacctatctctagacctccgaggtctaggaggacgaggctgacttattattgcagcctcatactactgtaagtcaaagttcggtaacttccgtaacgttcggtcgttgggttccgggcgggttacgggaaccctaaggttccgacccggtccgttacggtccgttaacggaaccccgg

SEQ ID NO: 387856 - DNA, 590 bp, Homo sapiens
  misc_feature: GZ8MTXP01BRNLQ.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatatatgtctctgttccaacagcattcaggcagccgaccccgaaacttctttaatttatgtacggttctttcgtcggtccctcgtacggggtttctagtcgtcttctccggctccgagtctggcaacgacgctccctgaccatctctacgactccgagctgacgacgagctgactattattgctagctctatactacgtagaacgttcaaagttcggttaacttccgtaacgttcgggtccgttcgggtttccgggcgggggttaaccggggtaacccgttaaacgggtttccgggtaaacccgggttcccgttaaacgggggttcccaacgggtaacccccgg

SEQ ID NO: 387857 - DNA, 540 bp, Homo sapiens
  misc_feature: GZ8MTXP01BUA6P.39.39.D06.1.454.CMB.2.raw
  modified_base (227)..(227): a, c, t, g, unknown or other
  modified_base (241)..(241): a, c, t, g, unknown or other
  modified_base (243)..(243): a, c, t, g, unknown or other
  modified_base (251)..(251): a, c, t, g, unknown or other
  modified_base (263)..(263): a, c, t, g, unknown or other
  modified_base (352)..(352): a, c, t, g, unknown or other
  modified_base (373)..(373): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactgaaccngcagtgacgttggntnttataatngtctctgtcaangcatcagcagccgacccgaaatcttaattatgtagttcttcgcgcctgtacggttctagtcgtcttcgtccgctcgaagtctgacaacncgctccctgacctatcactanactcgagctaggagacgagctacgacttagttatcgctaacgtctcgtagtttcactaaattcgaggtgtaacgtctttaacgttggttaccgttacgggtaaaggttccgggttaacttaaacgggtcacgttccgtccgtacggttcaaccgccccgtaaacccg

SEQ ID NO: 387858 - DNA, 532 bp, Homo sapiens
  misc_feature: GZ8MTXP01DSR0Y.39.39.D06.1.454.CMB.2.raw
  modified_base (270)..(270): a, c, t, g, unknown or other
  modified_base (367)..(367): a, c, t, g, unknown or other
  modified_base (424)..(424): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttataatatgtctctggttccaacngcattcaggcagccgaccccgaaatcttaatttatgagttctttcgtcggcctcgtaggggtttctagtcgtcttctcccggctcagtctggcaacncggcctcctgaccatctctagactcagctgagacgaggctgactattattgcagctnactatactagaagtcaagttggtattcctacgttggtcttggttcgggcgggttaagggtaaccctaaggttcggaacccgttccgttagggtccgaaggtaaccccg

SEQ ID NO: 387859 - DNA, 591 bp, Homo sapiens
  misc_feature: GZ8MTXP01C4FP7.39.39.D06.1.454.CMB.2.raw
  modified_base (229)..(229): a, c, t, g, unknown or other
  modified_base (270)..(270): a, c, t, g, unknown or other
  modified_base (453)..(453): a, c, t, g, unknown or other
  modified_base (478)..(478): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctcctgcactggaaccngcagtgacgttggtgcttaataatatgtctctgttaccaangctatcaggcagcccgaccccgtaaatcttaaatttatgtacggttctttcgtccgccttcgtacgggtttcagtcgtccttctccgctccgaagtcgtaggaccaacgtccgcctcccgtagaccctatctctacgacctacgaggtctggacggacgagctagtaacttagttatgactancctactaataactacgtagaacgtnaaaaggttgtaacttccgtacgttggtacttggggttaccgggacgggaacgggtaaccctaaacgggtttcgaaccccggttacggttaaggtcccgaacggtaacccccgg

SEQ ID NO: 387860 - DNA, 573 bp, Homo sapiens
  misc_feature: GZ8MTXP01A9SF7.39.39.D06.1.454.CMB.2.raw
  modified_base (268)..(268): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgttccaacngcattcaggcagccgaccccgaaattctttaaatttatgtaggttctttcgtcgcccttcgtacggggtttctagtcgtcttcgtccggctccaagtctggacaacgcggcctccctgacctatctctacgacctcccgaggtctaggacggacgaggtctagaacgttattattcgactagtcctcaattaatactagaacgttcaagttggtaacttccgtacgttggtcgttcgggttcgggcgggacgggtaacccgtaaggttcggtacccggtcgttacgggtcgttaaccggaacccg

SEQ ID NO: 387861 - DNA, 565 bp, Homo sapiens
  misc_feature: GZ8MTXP01A70MS.39.39.D06.1.454.CMB.2.raw
  modified_base (270)..(270): a, c, t, g, unknown or other
  modified_base (386)..(386): a, c, t, g, unknown or other
  modified_base (401)..(401): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaaangcattcaggcagccgacccccgtaaattctttaaatttatggtacggttctttccgtcggcccttcgtacggggtttctagtcgctttccgtcccggctccaagtctcgggcaacncggcctccctgaccntctctagactccgagctgaggacgaggctgacttattattgcagctcaattactactagaatcaaagtggtaacttcctacgttggtacttggttaccgggcgggttaacgggtaacctaaggttcgtacccggttcgttacgggtccgttaacggaaccccgg

SEQ ID NO: 387862 - DNA, 624 bp, Homo sapiens
  misc_feature: GZ8MTXP01BEPNR.39.39.D06.1.454.CMB.2.raw
  modified_base (229)..(229): a, c, t, g, unknown or other
  modified_base (244)..(244): a, c, t, g, unknown or other
  modified_base (253)..(253): a, c, t, g, unknown or other
  modified_base (267)..(267): a, c, t, g, unknown or other
  modified_base (525)..(525): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtncttataatntgtctctgtccaangcattcagcagccgaccccgaaatcttaatttatgtacgttcttcgcgccctgtacgggttctagtcgtcttcgccggtcttccgaagtccgtaggacctaaaccgccgggtcccctacccgtgaaccctattcctaccgtaacgaccttcccgaggtctagggaacggacgagggtcttaggtaaccttagtttacgttggacctagtcctaactattaaactaccgtaggtaactaccgtaaagttcggttaaacncccgtagttcggtccgtttcgggttacggggccggttaaaccggggtaactaaaggttccgaaacccgttcgttaacgggttccaacgggtaacccccg

SEQ ID NO: 387863 - DNA, 587 bp, Homo sapiens
  misc_feature: GZ8MTXP01CYUGF.39.39.D06.1.454.CMB.2.raw
  modified_base (229)..(229): a, c, t, g, unknown or other
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaanagcattcaggcagccgaccccgaaatcttaatttatgagttctttcgcgtcccttcgtacggggtttctagtcgtcctttcgtcccgggtctccgtaaagtcctcgggacaaccgaccggcccttccctacgaccctactcctactacgacctccgaaggtctaggacggacgagggtctaggaacttatttaagttgcagcctctaattactacgtagtaaagtcaaattggtaacttccgtaacgttggtccgtggtttcgggcggttacggtaacctaaggttcgacccgtcgttacggtccaacggtaacccg

SEQ ID NO: 387864 - DNA, 506 bp, Homo sapiens
  misc_feature: GZ8MTXP01EALJQ.39.39.D06.1.454.CMB.2.raw
  modified_base (228)..(228): a, c, t, g, unknown or other
  modified_base (270)..(270): a, c, t, g, unknown or other
  modified_base (370)..(370): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacngcattcaggcagcgaccccgaaatcttaatttatgtaggttctttcgtcggccctcgtacggggtttctagtcgcttctcccggctccaagtctgcaacncgctccctgaccatctctagactccaggctgagacgagctgactattatgcagctcataatctgaagtcaaagtgtattccacttggctggttcggcgggaggaacctaagtcgacgtcttaggtcaacgaacccg

SEQ ID NO: 387865 - DNA, 661 bp, Homo sapiens
  misc_feature: GZ8MTXP01C2U0X.39.39.D06.1.454.CMB.2.raw
  modified_base (264)..(264): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctcgtgtctgagactcctggacagtcgatcaccatctcctgcactggaaccagcagtgacgttgtgcttataatatgtctctgtccaangctatcaggcacgccgaccccgtaaatctttaaatttagtgaggtttctttcggtccggtcccttcgtacggggtttctaggttcgtccttcgtcccggctcctaagtcgtacgggaccaaccgaccggtccctacccgtcgaaccctacttcctacgttaacgacccgttaccgagggtcctagggaacgggtaacgaacgggtccttacggtaacctttaagtttacgttacggacctaacgtcccttaataacttaaagttaaccgtaagtaaaacgttcgtaaaagttcgggtttaaacttcccgtaacgttcggtcgttacgggttccgggacgggttaacggtaaccgtaaggttcgtaacccggttcttacgggtcaaccggtaaccccg

SEQ ID NO: 387866 - DNA, 610 bp, Homo sapiens
  misc_feature: GZ8MTXP01BK3RX.39.39.D06.1.454.CMB.2.raw
  modified_base (240)..(240): a, c, t, g, unknown or other
  modified_base (250)..(250): a, c, t, g, unknown or other
  modified_base (265)..(265): a, c, t, g, unknown or other
  modified_base (296)..(296): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactgaaccagcagtgacgttggntcttataatntgtctctgtaccaangcatcaggcagccgacccaaattcttaattngtacgttcttcgcgctgtacggttcagtcgtcttcgtccgctccgaagtcgtaggaccaaacgccggtccctccctacgacctacttcctacgtaacgaccttacccgaggtctacgggaacggacgaacgggtcttaacggtaacgtttaagtttacgttcgaccgtagtcccttactaaattacgtaacgtagtaacgtactaaagttcggtaacttcccgtacttgggtcgttgggttccgggcgggttaacgggtaaccgttaaggttccgacccggttacgttacgggtaaccgttaaccggtaacccg

SEQ ID NO: 387867 - DNA, 531 bp, Homo sapiens
  misc_feature: GZ8MTXP01C33B9.39.39.D06.1.454.CMB.2.raw
  modified_base (228)..(228): a, c, t, g, unknown or other
  modified_base (406)..(406): a, c, t, g, unknown or other
  modified_base (446)..(446): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccatcctcctgcactggaaccngcagtgacgttggtgcttataatatgtctctggttccaaacagcattcaggcagccgaccccgaaactcttaatttatgagttctttcgtcggcctcgtaggggtttctagtcgcttctccggctccaagtctgcaacacggcctccctgaccatctctagacctcaggctgagacgnggctgaacttattattgcagctcataagtactagaacgtnaatggtattcctagttggtacttggttacggcggaacgggtaactaagggttcgtaccgtccttaagggtccaacggtaaccccg

SEQ ID NO: 387868 - DNA, 545 bp, Homo sapiens
  misc_feature: GZ8MTXP01AR6AD.39.39.D06.1.454.CMB.2.raw
  modified_base (368)..(368): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaacccagcagtgacgttggtgcttataatatgtctctggttccaacagcattcaggcagccgaccccgaaactcttaatttatgtaggttctttcgcggcctctacggggtttctagtcgcttctccggctccagtctggcaacncggcctccctgaccatctctagcctcaggctagagacgagctgacttattagtgacagctcatatactagtaagttcaaagttggtaacttccaacgttggtcgttcggttcgggccgggaacgggtaaccctaaggtttccgaacccggtccgttagggtccgaacggtaaccccg

SEQ ID NO: 387869 - DNA, 560 bp, Homo sapiens
  misc_feature: GZ8MTXP01EK3WG.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataatatgtctcctggttccaacagcattcaggcagccgaccccgaaattctttaaatttatgtaggttctttcgtcggtccctcgtacggggtttctagtcgtcttctccggctccaagtctggcaacgacggctccctgacatctctagacttccgaggctagaggacgaggctgacttattagttgactagctcaattaactacaaagctattatctaagtttcggggtgttcggggacggtaacggggttacccgttcgttcgtaacccggttcgttaacggtccacgttcccgaacgggttcctccccgg

SEQ ID NO: 387870 - DNA, 547 bp, Homo sapiens
  misc_feature: GZ8MTXP01DKBIJ.39.39.D06.1.454.CMB.2.raw
  modified_base (229)..(229): a, c, t, g, unknown or other
  modified_base (267)..(267): a, c, t, g, unknown or other
  modified_base (425)..(425): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgtccaangcatcagcagccgaccccgaaatcttaatttatgtaggttctttcgtcggccctgtacgggtttctagtcgtcttctccgctccaagtctggacaacgcggcctccctgacctatctactagacctccgaggtctggaggacgaggctgaacttattntgcagctcatatactgtaatcaatcggtaacttccgtacgttggtacttggttaccgggcgggaacgggtaaccgtaacggttcggtaacccggtccgttaggtcccgaacggtaaccccgg

SEQ ID NO: 387871 - DNA, 549 bp, Homo sapiens
  misc_feature: GZ8MTXP01DUG85.39.39.D06.1.454.CMB.2.raw
  modified_base (228)..(228): a, c, t, g, unknown or other
  modified_base (242)..(242): a, c, t, g, unknown or other
  modified_base (252)..(252): a, c, t, g, unknown or other
  modified_base (265)..(265): a, c, t, g, unknown or other
  modified_base (297)..(297): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggntcttataatntgtctctgtcaangcatcagcagccaccccgtaaattcttaattntgtagttcttcgcgcctgtacgggttctagtcgtcttcgtccgctccgagtctggaccaacgccggcctcctgacctatctactacgactaccgagctggacggacgaggctagacttaattagtgacagtctactaattaacgtattaggaaattctaaagttaagtacttcgtacgttggccgttggttacgggcgggttaacggtaaccgtaagttccggacgtccgttaaggtccgaacggtaacccg

SEQ ID NO: 387872 - DNA, 545 bp, Homo sapiens
  misc_feature: GZ8MTXP01AOAER.39.39.D06.1.454.CMB.2.raw
  modified_base (269)..(269): a, c, t, g, unknown or other
  modified_base (391)..(391): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctggttccaangcattcaggcagccgaccccgaaatctttaatttatgtaggttctttcgtcggccctgtacggggtttctagtcgtcttcgtcccggctccaagtctggcaacacggcctccctgaccatcnctacgactcaggctggaggacgaggctagactattattgcagctactatactactagaagtcaagtggtacttcctacgttggacttggttcgggcggttaacggggaactaacggttcggacccgttaccgttaggttccgaacgtaacccgg

SEQ ID NO: 387873 - DNA, 577 bp, Homo sapiens
  misc_feature: GZ8MTXP01BICTL.39.39.D06.1.454.CMB.2.raw
  modified_base (229)..(229): a, c, t, g, unknown or other
  modified_base (266)..(266): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataatatgtctctgtccaangcatcaggcagccgaccccgtaaatcttaatttatgtagttctttcgccggtccctgtacgggtttcagtcgtcttctcccggctccgaagtctggaccaacgcgtccctccctgaccctatctctacgacctccgaggctagaggacgaggctgacttattagtgctagctcattatacgtagaaacgtctaaagttggtaacttccgtacgttgggtccgttagggttccggggcgggttaacgggggtaaccctaacggggtttccggaacccggttacccggttaagggtccgaaccggaaccccgg

SEQ ID NO: 387874 - DNA, 589 bp, Homo sapiens
  misc_feature: GZ8MTXP01BJGF2.39.39.D06.1.454.CMB.2.raw
  modified_base (363)..(363): a, c, t, g, unknown or other
  modified_base (369)..(369): a, c, t, g, unknown or other
  modified_base (377)..(377): a, c, t, g, unknown or other
  modified_base (389)..(389): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataatatgtctcctggtccaacagcattcaggcagccgaccccgaaattctttaatttatgtagttctttcgtcgtccctgtacgggtttctagtcgtcttcgtccgctcagtcnggcacncgcctccngactatctctanctcgagctggagacgagctgtacttatttattcgcagtctactaattactaacgtagtaagttactaaagttcggttaacttccccgtaagttcgggtccgttggggttacccgggggcgggttaaacggggtaacccgtaaacggtttccggaaaccccggtttccggttaacgggttcccgaaccggtaacccccggg

SEQ ID NO: 387875 - DNA, 674 bp, Homo sapiens
  misc_feature: GZ8MTXP01CLGSJ.39.39.D06.1.454.CMB.2.raw
  modified_base (287)..(287): a, c, t, g, unknown or other
  modified_base (417)..(417): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatgaagtggtggagttgggtccgccgacgcccccgaggggaaggggctggagttggattggtagaaataaagtggaggaccgggggcaaccgaactacaancgccgtcccgtcgacggggtcgacgtccaccatactctgacaagaaccaacgtaccaaacgaaccctacttcctccgtgacgctcgacccctcgtgtcgacccgccgacggactcgctaatattatatgngcgtagttagttttgcgtaggtagttcggttggggtcgttacgtcggtacggttcggtgggggtaccgtaaggggtacgttaccggtacgggttctaacgttccgttcctccgttccgaccgtccctaccacccggtaacgggcccctaacggttccccggttcccctttccccggcggtccccgtccccgttcgcccgttacccgggaacggtaccgtccccgaacccgtccggacgtaaccggcccgaacccggg

SEQ ID NO: 387876 - DNA, 585 bp, Homo sapiens
  misc_feature: GZ8MTXP01BF6XL.39.39.D06.1.454.CMB.2.raw
  modified_base (229)..(229): a, c, t, g, unknown or other
  modified_base (244)..(244): a, c, t, g, unknown or other
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtntacttataatatgtctctggttaccaanagcattcaggcagcccgaccccgtaaattctttaaatttatgtagttctttcgcgcctgtacgggtttcagtcgtcttcctccggctcgagtctggacaacgcggcctccctagacctatctactacgacctccgaggtctaggaacggacgagtctagaacttattagtcgactagctactaatatactagtaaacgtctaaagttcggtaacttcctacgttcggtcgtttcgggttaccggggcggttaacgggtaaccctaagggtttccgaacccggttcgttaacgggtccgaaccggtaaccccgg

SEQ ID NO: 387877 - DNA, 712 bp, Homo sapiens
  misc_feature: GZ8MTXP01CME80.39.39.D06.1.454.CMB.2.raw
  modified_base (229)..(229): a, c, t, g, unknown or other
  modified_base (242)..(242): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgngcttatatatgtctctgttccaacagctattcaggcagccgacctacgaaactttctttaaatttatggtacgttctttcgtcgtcccttcgtaggggtttcacgtccgtctttccgtcccggtctacccgtaaagttccgtacgggaccaaacccgtccgggtaccccttcccgtacgaaccctatccttaccgtacgaccttcccgaaggtccgtaggaacgggaaccgagggtaccttaggggtaaacctttaagtttaaccgttggacctaacggtcccttaaataaattaccttaaacgttacggtaaaaggttaacctaaaagttcgggttaaaccttacccgaaggttacgggtcgttttacggggttccgggggaccgggtaaaacggggtaaacccctttaaagggttttcccgggaacccggtttaccccggttaacgggttaacccgtaaaccccgggg

SEQ ID NO: 387878 - DNA, 630 bp, Homo sapiens
  misc_feature: GZ8MTXP01BUCK5.39.39.D06.1.454.CMB.2.raw
  modified_base (244)..(245): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtnnttataatatgtctctgtccaangcatgagcagcccgacccgaaattcttaatttatgtaggttctttccggccggtccccgtaggggtttccctaggtcgtcttccgtcccggtactaccgaagtctcgggtaccaaccgaccggtcccctccgtacgaccctatcctctacgacctccgaaggtctagggaacggacgagggtccttagtaaccgttagtttacgttggactacgtcctactaattaactacgtagtaaacgttactaaagttggtaaactccgacgttcgggttacgttcggttaccggggacggttacgggttaaccttaagggttccgtaacccggttacgtacgggttaccaacggttcccgtaaccggg

SEQ ID NO: 387879 - DNA, 543 bp, Homo sapiens
  misc_feature: GZ8MTXP01EQTBJ.39.39.D06.1.454.CMB.2.raw
  modified_base (256)..(256): a, c, t, g, unknown or other
  modified_base (270)..(270): a, c, t, g, unknown or other
  modified_base (304)..(304): a, c, t, g, unknown or other
  modified_base (418)..(418): a, c, t, g, unknown or other
  modified_base (453)..(453): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaaccagcagtgacgttggtgacttataatntgtctctgtccaangcattcagcagccacccctaaattcttaaatttngtagttctttcgcgcctgtacgggtttcagtcgtcttccgtacccggctccgaagtctcgggaccaaaccgccggccttccctagaccctatcctactacgaccttcgaggtcnggacggacgaggctagacttagttatgacagctanatatctagaatcaagtgtacttccgattggcttggttccgggcggaacggtaacctaagttcgaccgttccgaggttccgaacgtccccg

SEQ ID NO: 387880 - DNA, 557 bp, Homo sapiens
  misc_feature: GZ8MTXP01D3VSO.39.39.D06.1.454.CMB.2.raw
  modified_base (225)..(225): a, c, t, g, unknown or other
  modified_base (436)..(436): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcacatctctgcactggaaccngcagtgacgttggtgcttataatatgtctcctgttccaacagctattcaggcagccgaccccgtaaactctttaatttatgtaggttctttcgtcgcctcgtacggggtttctagtcgtcttcgtcccgctccgagtctggcaacacggcctcctgaccatctctacgactcaggctgacggacgagctagacttattattgcagtcctanattatactgaaagttccaaagttcggtaacttccgtacgttggtcgttacggttcgggcgggttaacggggaacctaaaggttcgtaacccggttcgttaacgggtccaacggtaaccccg

SEQ ID NO: 387881 - DNA, 574 bp, Homo sapiens
  misc_feature: GZ8MTXP01DTSDU.39.39.D06.1.454.CMB.2.raw
  modified_base (228)..(228): a, c, t, g, unknown or other
  modified_base (243)..(244): a, c, t, g, unknown or other
  modified_base (252)..(252): a, c, t, g, unknown or other
  modified_base (265)..(266): a, c, t, g, unknown or other
  modified_base (294)..(294): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtnnttataatntgtctctgtcaanncatcagcagccgaccctaatcttaattngtagttctttcgcgcctgtacgggttctagtcgtcttcgtccgctccgaagtcgtacggaccaaccgccggcccttccctacgaccctattcctactaacgacctaccgaggtctaggacggacgaggtctagtaacttatttagtcgacagtctacattaactactagtaacgtactaagttgtacttccgtacgttggtcgttgggttccgggcgggttaacgggtaaccgttaaggtccgtaacccggttcgttacggtaaccgaaccggtaacccg

SEQ ID NO: 387882 - DNA, 525 bp, Homo sapiens
  misc_feature: GZ8MTXP01B0EN9.39.39.D06.1.454.CMB.2.raw
  modified_base (269)..(269): a, c, t, g, unknown or other
  modified_base (271)..(271): a, c, t, g, unknown or other
  modified_base (346)..(346): a, c, t, g, unknown or other
  modified_base (488)..(488): a, c, t, g, unknown or other
  modified_base (516)..(516): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtcaggcctgacacagcctgccctccgtgtctgagactcctggacagtcatcaccatcctcctgcactggaaccagcagtgacgttggtgcttataatatgtctctgttccaangnatcaggcagccgccccgaaatcttaatttatgaggttctttcgtcggtccctgtacggggtttctagtcgcttcnccggtctccgaagtctgggctaacgacggccctccctgacccagtctctacgactccgaggtctggaggacgaggctagacttattattgctagctcattagtactgaagtcaagtggtaacttccagttgtctggttcggnggaggaactagtcgcgtcgttaggtccnggtaacccg

SEQ ID NO: 387883 - DNA, 553 bp, Homo sapiens
  misc_feature: GZ8MTXP01ASFRL.39.39.D06.1.454.CMB.2.raw
  modified_base (227)..(227): a, c, t, g, unknown or other
  modified_base (268)..(268): a, c, t, g, unknown or other
  modified_base (407)..(407): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctggttccaacngcattcaggcagccgaccccgaaacttcttaatttatgtagttctttcgtcgtccctgtacggggtttctagtcgtcttcgtccgctccagtctggcacacggcctccctcgacatctctagactccagctagagacgngctgacttattattgcagctcattatactaggtaactctaagtggtaacttcctaacgttggtaccttagggttcgggcgggttaacggggtaaccctaaagggttcgacccggttaccgttaacgggttcgaaccggtaaccccg

SEQ ID NO: 387884 - DNA, 655 bp, Homo sapiens
  misc_feature: GZ8MTXP01AP1M8.39.39.D06.1.454.CMB.2.raw
  modified_base (351)..(351): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaaggggctggagttggattggtagaaataagtgaggaccgggggcaaccaactacaatgcgtccctcgagggtcgagtcaccatatctgcagacaagtccaagacccacttctcctgacgctcgacccctntgtcgacccgccgcggactcggccatatattattgtgacgtagttgttttggacgtaggtattcggttgggggacgttagtccgggtacgttccggttagggggtaccgtaaaggggtacttccggaacgggttccaacgttccgtccctcccgttcaaccggtcccctacccgaaacccgaaacggggtcccctaacgttcccgggttcccttccccccggttgggcccccgtccccgttcggccccttacccggaacgggaccgcccgaacccggtccggaaccgtaacggcccaacccggg

SEQ ID NO: 387885 - DNA, 519 bp, Homo sapiens
  misc_feature: GZ8MTXP01D2QOZ.39.39.D06.1.454.CMB.2.raw
  modified_base (242)..(242): a, c, t, g, unknown or other
  modified_base (488)..(488): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccagcagtgacgttggtncttataatatgtctctgttccaacagcattcaggcagccgacccgaaacttcttaatttatgaggttctttcgtcggcctcgtacggggtttctagtcgtcttcgtcccggctccgaagtctggacaacgaccggcccttccctgaccctatctactacgacctccgaggctaggaggacgaggctagacttattattgactagctcaagtatactgaatcaatgtattcagttggctggttcggnggaggaactagtcgacgtcaggtcaagcccg

SEQ ID NO: 387886 - DNA, 660 bp, Homo sapiens
  misc_feature: GZ8MTXP01DPYY9.39.39.D06.1.454.CMB.2.raw
  modified_base (276)..(276): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatcctcctgcacgtcggaaccagcagtgacgttggtgtcttaataatatgtccttcctggttccaangctattcaggcagcccgaccccgtaaattctttaatttagtgtacggtttctttccgtcggtccctcgtacggggtttcctagtccgtcctttcccgtccccgggtcttcccgtaaagttccgtacgggacccaaaccgaccgggtcccctccctacgacctacttcctcttaacgaccttccgaggtcctaggacggaccgaggtccgtagtaacttatttagttcgactagcttactaattaactactaggtaaatctaaagttcggttaacttcccgtacgttggtacgttcggggtttaccgggcggggttaaaccggggtaaccgttaaacgggttccggtaacccggtccggttacggtccgaaccggtaaccccggg

SEQ ID NO: 387887 - DNA, 545 bp, Homo sapiens
  misc_feature: GZ8MTXP01CALBM.39.39.D06.1.454.CMB.2.raw
  modified_base (229)..(229): a, c, t, g, unknown or other
  modified_base (270)..(270): a, c, t, g, unknown or other
  modified_base (393)..(393): a, c, t, g, unknown or other
  modified_base (435)..(435): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaanagcattcaggcagccgaccccgtaaatctttaaatttatgtaggttctttcgtcggtccctcgtacggggtttctagtcgtctctccggctcaagtctcggacacacggcctcctgaccatcnctagactcagctgaggacgagctagactattattgacagctnacttatactgtaaagtcaaagtcggtaacttcctacttggcttggttccggggcggacgggtaaccctaaggttcgtacccggtccgttaggtccgaacggtaaccccgg

SEQ ID NO: 387888 - DNA, 504 bp, Homo sapiens
  misc_feature: GZ8MTXP01DKDQ4.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctcctggttccaacagcattcaggcagcgaccccgaaactcttaatttatgaggttctttcgtcggccctcgtacggggtttctagtcgcttctccggctcaagtctggcaacacggcctccctgaccatctctagactccaggctgaggacgaggctgactattattgcagctcatatactgaagtcaatgtattccattgctgttcggcggaggaaccaagttcgacgtcttaggtcaacgaacccg

SEQ ID NO: 387889 - DNA, 599 bp, Homo sapiens
  misc_feature: GZ8MTXP01BK8LD.39.39.D06.1.454.CMB.2.raw
  modified_base (230)..(230): a, c, t, g, unknown or other
  modified_base (268)..(268): a, c, t, g, unknown or other
  modified_base (277)..(277): a, c, t, g, unknown or other
  modified_base (366)..(366): a, c, t, g, unknown or other
  modified_base (375)..(375): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccngcagtgacgttggtgcttataatatgtctctgtcaacngcatcagcngccgcccgaaatcttaatatgagttctttcgcgcctcgtacgggtttctagtcgtcttcgtcccgctcagtctggcaacgcgcctcccngacctatcnctagactccgagtctgagacgaggctagacttattagttcgactagtcctctataactcgtaggaaacttcgaaagttcgggttaaacttcccgtaaagttcggggtcctttcgggggtttacccggggacggggttaaaccgggggtaaccgttaaaaccggtttcgggtaacccccggtttacggttaacggggttaaccccgaacgggttaaccccccggg

SEQ ID NO: 387890 - DNA, 566 bp, Homo sapiens
  misc_feature: GZ8MTXP01DNZE7.39.39.D06.1.454.CMB.2.raw
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataatatgtctctggtccaangcatcaggcagccgaccccaaattcttaatttatgacgttctttcgcgcctgtacgggtttctagtcgtcttcgtcccggctccgaagtcgtacggacaaaccgaccggccctccctagaccctatcctactacgacctccgaggctaggacggacgaggctagacttattatgctagctacatatacgtagaaacgtcaaagttcgtaacttccctagttggtcgttgggttcggggcggttaacgggtaacctaaggttccgaccggtaccgttacggtccgaacggtaaccccg

SEQ ID NO: 387891 - DNA, 613 bp, Homo sapiens
  misc_feature: GZ8MTXP01CL9V3.39.39.D06.1.454.CMB.2.raw
  modified_base (275)..(275): a, c, t, g, unknown or other
  modified_base (388)..(388): a, c, t, g, unknown or other
tcagtcgcactagtcacgaccggtgctcgatttagtgacatctcgcagtttcgtttgggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccagcagtgacgttggtgcttataatatgtctctggttaccaacngctattcaggcacgccgaccccgaaacttctttaaatttagtgtacggttctttccggtccgcccttcggtacggggtttctagtcgtcttcgtccgtctcagtcgtgacacncgcctcctgaccatctcacgactccgaggctaggagggacgaggtactagtacttagtttaagttgactaagtcctactaaacttactaacgtagtaaacgtacctaaaggttcggttaacttccgtaagtttcgggtacgttgggtttccggggcgggttaacgggtaacctaaaggttcggaacccggttccggttacgggttaaccgaacgggtaaccccgg

SEQ ID NO: 387892 - DNA, 538 bp, Homo sapiens
  misc_feature: GZ8MTXP01BZWN9.39.39.D06.1.454.CMB.2.raw
  modified_base (374)..(374): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatatatgtctctgttcaacagcattcagcagccgaccccgaaactctttaatttatgtaggttctttcgtcggccctcgtacgggtttctagtcgcttctcccggctcagtctgcaacacgcctcccngaccatctctagactccgaggctgaggacgagctgacttattattcgcagctacagttactactgaagtcaagtggtacttccacgttcggcgttcggttcgggcggggacgggtaacccgtaggtttcgacccggttccgttaggttccgaacgtaaccccgg

SEQ ID NO: 387893 - DNA, 559 bp, Homo sapiens
  misc_feature: GZ8MTXP01A82AW.39.39.D06.1.454.CMB.2.raw
  modified_base (268)..(268): a, c, t, g, unknown or other
  modified_base (367)..(367): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgttccaangcattcaggcagccgaccccgtaaattctttaaatttatgtagttctttcgtcggccctcgtacgggtttctagtcgtcttctccgctcagtctgcacncgcctcctgacctatctctacgactccaggtctgacggacgagctacgacttattattcgactagtctcattatactagaaacgttcaaagttcggtacttccgaacgttcgggtacgttcgggttacgggcgggttaacgggtaaccgtaaggttcgaacccggttcgttacggtccgaacgtaaccccgg

SEQ ID NO: 387894 - DNA, 715 bp, Homo sapiens
  misc_feature: GZ8MTXP01CVM3Z.39.39.D06.1.454.CMB.2.raw
  modified_base (367)..(367): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccagcagtgacgttggtgacttaataatatgtctcctggttccaaacagctattcaggcacgccgaccccgtaaaattcttaaatttatggaggtttcctttacggtccgccttcgtacggggtttctagtcgtcctttccncccgggcttcccgaagtcgtacgggtaccaaaccgacccggtccctaccctacgaccctaattcctactaacgtaccctaccgaacggtccgtagggaacgggacgacggtacccgttaggtaaccgtttaattttaagttcggaccttaacggtcctttaaccgtaatttaaaacccttaacgttagggtaaaacggttccttaaaaaggtttcggtaaaccttcccgtaacgttcggggttaccgttcggggtttacgggggaccgggttaaacggggtaaacccgtaaacgggttcggtaaaccccggtttcggaacggggttaacccaacccgggtaaccccgg

SEQ ID NO: 387895 - DNA, 733 bp, Homo sapiens
  misc_feature: GZ8MTXP01ASPO3.39.39.D06.1.454.CMB.2.raw
  modified_base (244)..(244): a, c, t, g, unknown or other
  modified_base (273)..(273): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtncttataatatcgtctccgtggttaccaangctattcaggcacgccgaccccgtaaaattctttaaatttatcggtaggttcctttcggtccggtccccttcgtacggggttttcctagtccgtctttcctcccgggctccgaagtcgtgggaccaaccgtcggtcccctacccgtgaaccctacttcctacgtacgtacccgtcccgaagggccgttagggacgggaacccgtagggtccttaggtaacctttaagtttagttcgaccgtaagtcccttacgtaaattaactaaccgttaaggtaaacgttaaccgaaagtttcgggtaaacttcccccggtaaagttccgggggttaccgttacgggggtttccccgggggaaccgggggttaacggggttaaacccccgtaaagggggttttcccggtaaaaccccgggttcccgggttaaaccgggttccccgttaaacccggggtaaccccccgg

SEQ ID NO: 387896 - DNA, 507 bp, Homo sapiens
  misc_feature: GZ8MTXP01AOBAE.39.39.D06.1.454.CMB.2.raw
  modified_base (499)..(499): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagccgaccccgaaactcttaatttatgtaggttctttcgtcggccctcgtacggggtttctagtcgtcttctccggctcagtctggcacacggcctccctgaccatctctacgactcagctgaggacgagctgactattatgcagctcatatactgaagtcaatggtaattccagttgctgttcggcggaggaaccaaggttcgaccgtcgttagtcncgaacccg

SEQ ID NO: 387897 - DNA, 631 bp, Homo sapiens
  misc_feature: GZ8MTXP01CFFPV.39.39.D06.1.454.CMB.2.raw
  modified_base (244)..(244): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtncttataatatgtctctggtaccaacagctattcaggcaggcccgaccccgtaaaattctttaaatttatgacgttctttcgcgcccttgtacggggtttctagtcgtctttccgtcccggctccgaagttcctagggaccaaaccgacccggtccccttccccgtacgaaccctattcccgtacctaagacccttcgaacgggtcctagggacgggacgaggtcctaggtaaccttatttaacttggacctgccctataagttaactcgtaagaaacgttcaaagttggtaacttccctacgttcgggtcgttgggttaccggggcgggaacgggtaaccgtaaggttccggtaaccgttccggttaggtccgaacggtaaccccgg

SEQ ID NO: 387898 - DNA, 642 bp, Homo sapiens
  misc_feature: GZ8MTXP01DR7A9.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccagcagtgacgttggtgtacttataatatgtctctgttaccaacagcattcaggcacgccgacccccgtaaattactttaaatttagtgtacggttctttccggcgtcccgtcgtacggggtttctagtccgtcttccgtcccggactccgaaagtcgtagggaccaacgtaccggccctccccgtagaccctatcctacttacgacctaccgaggctaggaggacgaggtactgtaacgtttatttaattcggacctaagtcctactaattaattacgtaggtaaattacctaaattcgggttaaacttccccgtaattcgggtccttggggtttaccgggcgggttaacggggtaacccgtaaaaggtttccgtaacccggttccgttacggtaacgttaaccgaacccccggg

SEQ ID NO: 387899 - DNA, 653 bp, Homo sapiens
  misc_feature: GZ8MTXP01CATW3.39.39.D06.1.454.CMB.2.raw
  modified_base (230)..(230): a, c, t, g, unknown or other
  modified_base (429)..(429): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtacttataattatgtcttccgtaggttaccaaacagactattcgaggcacgccgaccccgtaaattctttaaatttagtgtacggttcctttccggtccggtccctggttacggggtttctaggtccgtccttccgtcccgctccgaagtccgtaggaccaaccgacccgtcctccctgacctntactactacgaccgtaccgaggtctaggacggacggtacgtcgtacgtaactttaagtttcgtacgtaccgagtcccttaataagttaactaacgttaagtaagttacgtaaagttaacggtaacttccgttacgttggtaccgttgggttccggggacgggttaacgggtaacgttaacggttccgtaaccggtcgttacggtaaccgaaccggtaaccccgg

SEQ ID NO: 387900 - DNA, 647 bp, Homo sapiens
  misc_feature: GZ8MTXP01C1T0Z.39.39.D06.1.454.CMB.2.raw
  modified_base (268)..(268): a, c, t, g, unknown or other
  modified_base (404)..(404): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttgtgcttataatatgtctctgttccaangcattcaggcagccgaccccgtaaactctttaatttatgtacgttcgtttccggtccggtcccttcgtacggggtttctagtcgtcttccgtcccggctccgaagtctcgggacaaccgcggcctccctgaccctntcctctacgacctccgaggtcctaggacggtaccgaggtaccttaggaacctttagtttaacgttcggacctacgtccttactaatttaacgtaaccgttaagtaaacgttaccgtaaagttcgggttaaccttaccgtaacgttcgggttacgtttcgggttaccgggggaccgggttaaccggggtaaccttaaggttccgtaaacccggttcggttaacggtccgaaccggtaaccccgg

SEQ ID NO: 387901 - DNA, 603 bp, Homo sapiens
  misc_feature: GZ8MTXP01CHY1B.39.39.D06.1.454.CMB.2.raw
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgtccaangcattcaggcagccgaccccgaaactcttaatttatgtaggttctttcgtcggtcccttcgtacggggtttctagtcgtcttcgtcccggctccgaagttcctagggcaaaccgaccggtccctccctgacctactctctagacctccgagggcctggaacgggacgaggtctagtaacttagtttaagttcgaccgtagtcctactattaactactagtaacgtacaaagttcggtacttccgaacgttggacgttggttccggggcgggttaacggggtaaccctaaacggtttcggaacccggttccgttacgggtccgaacggtaaccccgg

SEQ ID NO: 387902 - DNA, 680 bp, Homo sapiens
  misc_feature: GZ8MTXP01AHKVC.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcagggggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatgtctctggtccaacagctattcaggcacgccgaccccgtaaattacttaatttatgtacggttctttcgtcggtccctcgtacggggtttcctaggtcgtctttccgtcccggtaccttcccgtaacgttcctacggggacccaaacccgacccgggtccccttaccccgtacggtacccctaattccctaccgtaacggtacccttacccgacgggtaccttagggacgggacgtacgggtccttagtaaccttaagtttaagttcggactaacgtccttacattaacttacgtaggtaaagttacctaaagttcgggttaactcccgttacgtacggttcgttcgggttaccgggacgggttacggggaccttaagggttcggaacccgttcggtacggttaccgaacggttccccgtaacggg

SEQ ID NO: 387903 - DNA, 547 bp, Homo sapiens
  misc_feature: GZ8MTXP01A8A4Q.39.39.D06.1.454.CMB.2.raw
  modified_base (227)..(227): a, c, t, g, unknown or other
  modified_base (240)..(240): a, c, t, g, unknown or other
  modified_base (248)..(248): a, c, t, g, unknown or other
  modified_base (260)..(260): a, c, t, g, unknown or other
  modified_base (262)..(262): a, c, t, g, unknown or other
  modified_base (354)..(354): a, c, t, g, unknown or other
  modified_base (361)..(361): a, c, t, g, unknown or other
  modified_base (383)..(383): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctgacctgacacagcctgcctcgtgtctgagactctggacagtcgatcaccatctcctgcactggaaccngcagtgacgttgntctatatntgtctctgtcangnatcagcagccgaccctaaatcttaattagtgtagttcttcgcgcctcgtacggtttcagtcgtcttcgccgctcagtctgcacgcgcctccngacatcnctagactccgagctggagacgngctgacttattagtgactagtcctactattaactacgtaggtaacgtactaaagttcggttaacttcccgtacgttcggtccgttgggttccggggacgggttaacgggtaacctaaaggttcggtaaccccgttcggttaacgggttccaacggtaaccccgg

SEQ ID NO: 387904 - DNA, 591 bp, Homo sapiens
  misc_feature: GZ8MTXP01EFKMJ.39.39.D06.1.454.CMB.2.raw
  modified_base (230)..(230): a, c, t, g, unknown or other
  modified_base (246)..(246): a, c, t, g, unknown or other
  modified_base (275)..(275): a, c, t, g, unknown or other
  modified_base (313)..(313): a, c, t, g, unknown or other
  modified_base (345)..(345): a, c, t, g, unknown or other
  modified_base (397)..(397): a, c, t, g, unknown or other
tcagtcgcactagtcacgaccggtgctcgatttagtgacatctcgcagttctttggggggggtctcaggaggcagcgctctcaggacatctccaccatggcccgggctctgctgctcctcaccctctcactcagggcacagggtcctgggcccagtctggcctgacacagcctgcctccgtgtctgagactccgtggacagtcgatcaccatctcctgcacgtggaaccngcagtgtacgttggtntcttataattatgtctcgttgtaccaacngctatcaggcacgccgaccccgtaaattcttaaatttngtacgttctttcgtccgcctgtagggtttccngtctcttcgtccgtctacgaagtctagaccaacgccgccctcctagaccctntcctactacgcctcgaaggtctaggagtacgagtctagtaactttattagtcgacacgtactacaattataccgtagtaaactagtaagttcggtaactcgttacggtcgttcgtagggttacgggacggttacggttaaccgtaacggttcgaacccggttagtacgggttacaaccgttaacccggtaacgg

SEQ ID NO: 387905 - DNA, 657 bp, Homo sapiens
  misc_feature: GZ8MTXP01BMTE5.39.39.D06.1.454.CMB.2.raw
  modified_base (272)..(272): a, c, t, g, unknown or other
  modified_base (512)..(512): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatcctcctgcactggaaccagcagtgacgttggtgtcttataatatgtctcgtgttccaangctattcaggcacgcccgaccccgtaaactctttaatttagtggtaggttcctttcggtccggcccttggtacggggtttctacgtccgtccttccgtccggtccttccgaacgttcctacgggaccctaaccgaccgggtccccttacccgtcgaacctacttcctcctaacgcccttaccggacggtcgttaggaacgggaccgtagggactggtaacttatttacgtgacagtcctntaatacttagtcgtaaagtctaaagttcggtaacttccgtacgttcgggtaccgttcgggttaccgggccgggttaacggggtaacccgtaaggtttccggtaaccccggttacggttaaccggttccgaaccggtaacccccgg

SEQ ID NO: 387906 - DNA, 524 bp, Homo sapiens
  misc_feature: GZ8MTXP01D1PL7.39.39.D06.1.454.CMB.2.raw
  modified_base (228)..(228): a, c, t, g, unknown or other
  modified_base (424)..(424): a, c, t, g, unknown or other
  modified_base (476)..(476): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataatatgtctctgttcaacagcattcaggcagccgaccccgaaactctttaaatttatgaggttctttcgtcgccctcgtacggggtttctagtcgcttctcccggctccaagtctggcaacacggcctccctgaccatctctagactccaggtctgaggacgaggctgacttattnttgcagctcattatactgaagtcaagtgtacttcgacttggctggttcgggngggagggtaaccctaagttcgacccgtcttacgggtcaacgtaacccg

SEQ ID NO: 387907 - DNA, 646 bp, Homo sapiens
  misc_feature: GZ8MTXP01DP2N4.39.39.D06.1.454.CMB.2.raw
  modified_base (249)..(249): a, c, t, g, unknown or other
  modified_base (261)..(261): a, c, t, g, unknown or other
  modified_base (284)..(284): a, c, t, g, unknown or other
  modified_base (444)..(444): a, c, t, g, unknown or other
tcagtcgcactagtcacgaccggtgctcgatttagtgacatctcgcagttcgtttggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcactatctcctgacacgtggaaccagcagtcgacgttggtntattaataaatntgtacctctaggtaccaaacgtnactatacgacgacacgtacccgtaaacccttaaatttactttaagttagtacggtacgtttccgttccggccgtaccgttaggttaccggtttactacgtccgtcgttcccgtaccgtactaacgtaagtcgacgaaccaaccgtccgtccctaccgtanacctactctacgtacgaccgtacgaggtcgtagggaacggacgtagtactaacgtaacttaagttacgtcgactatactactaataactaacgtaagtaacgtaacgtaagtaacgtacgttacgtacgttcggtcgtcggttacgggttacgggacggtaacgtacgtaacgtacgtacgttacgtaaccgaacgtaaccg

SEQ ID NO: 387908 - DNA, 534 bp, Homo sapiens
  misc_feature: GZ8MTXP01D3ZLC.39.39.D06.1.454.CMB.2.raw
  modified_base (241)..(241): a, c, t, g, unknown or other
  modified_base (262)..(263): a, c, t, g, unknown or other
  modified_base (289)..(289): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcatcacatctcctgcactggaaccagcagtgacgttggtncttatatatgtctctgtcaanncatcagcagcgacccaatcttaattntgtagttcttcgtcgcctcgtacgggtttctagtcgcttctccgtctcgagtctcggacaacgacgggccttccctagacctacttcctactacgacctccgaggtctagaggacgaggctagacttattattgcagctacattatacgtgaagtacaagttggtaacttcctacgttggacgttggttcgggacggttagggaaccctaaggtcggacccgtcgttagggtccaacgtaacccg

SEQ ID NO: 387909 - DNA, 530 bp, Homo sapiens
  misc_feature: GZ8MTXP01EDR6B.39.39.D06.1.454.CMB.2.raw
  modified_base (243)..(243): a, c, t, g, unknown or other
  modified_base (266)..(266): a, c, t, g, unknown or other
  modified_base (302)..(302): a, c, t, g, unknown or other
  modified_base (380)..(380): a, c, t, g, unknown or other
  modified_base (386)..(386): a, c, t, g, unknown or other
  modified_base (429)..(429): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggncttataatatgtctctgtccaangcatcaggcagccgaccccgtaaattcttaaatttntgtacgttctttcgccgtccctgtacgggttttcagtctcttcctccgctccgaagtctggaccaacgcgcctccctnacatcntagctcagctggacgacgagctagacttaattgtgcagcctanattatatagtaatacaagtcgtacttcctagttcgtcgttgggttcggacggttacggtaactacgtaacgtcccgtaccgttacgtaacgttcgaacccg

SEQ ID NO: 387910 - DNA, 609 bp, Homo sapiens
  misc_feature: GZ8MTXP01ARMKY.39.39.D06.1.454.CMB.2.raw
  modified_base (244)..(244): a, c, t, g, unknown or other
  modified_base (253)..(253): a, c, t, g, unknown or other
  modified_base (265)..(266): a, c, t, g, unknown or other
  modified_base (373)..(373): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtntctataatntgtctctgtcanncatcagcagccacccgaaatcttaattatgtagttcttccgcgccctgtacgggtttcagtcgtcttcgtccgctcgagtctggacaaccgcggccctcctgacctntctactacgactaccgaggtctagggacggacgaaggctgtaacttattacgttgactagcttacaattaacgtactacggtaaagtacctaaagttaacggttaacttaccgtacggttcgggttacgtttacgggttacccgggggttacgggttaaccgggggaaaccctttaaacggtttccgggtaaaccccggttcggttaacgggttcccgaacccggtaaccccgggg

SEQ ID NO: 387911 - DNA, 570 bp, Homo sapiens
  misc_feature: GZ8MTXP01E4G0U.39.39.D06.1.454.CMB.2.raw
  modified_base (229)..(229): a, c, t, g, unknown or other
  modified_base (243)..(243): a, c, t, g, unknown or other
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggngtcttataatatgtctcctggtccaaanagcattcaggcagccgaccccgaaattcttaatttatgtaggttctttcgtcggccctcgtacggggtttctagtcgtcttcgtccggctccgaagtctggacaacacggcctccctgaccatctctacgactcaggctggagacgaggctagacttattatgacagctcaatactacgtagtaaagtcaaagtcggtaacttcccgaacgttggcgttcggttccgggacgggttaacggggtaaccctaaggtttccgaacccggttccgttaacgggtcccgaacggtaaccccgg

SEQ ID NO: 387912 - DNA, 557 bp, Homo sapiens
  misc_feature: GZ8MTXP01D2BP5.39.39.D06.1.454.CMB.2.raw
  modified_base (227)..(227): a, c, t, g, unknown or other
  modified_base (241)..(241): a, c, t, g, unknown or other
  modified_base (414)..(414): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggngcttataatatgtctctggttccaaacagcattcaggcacgcgaccccgaaattcttaatttatgagttctttcgtcgcccttgtacggggtttctagtcgctttccgtcccggcttccaagtctacggcaacgcggccctcctgacctatctctagactccagctgagacgngctgactattatgactagctcgattatactagaagtaccaagttggtaacttccgaacgttcggtacgttggtttaccgggcgggttaacgggaaccctaaaggttccgaaccgttccgttacgggttccaacggtaaccccg

SEQ ID NO: 387913 - DNA, 613 bp, Homo sapiens
  misc_feature: GZ8MTXP01BDJ45.39.39.D06.1.454.CMB.2.raw
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataatatgtctctgttccaangcattcaggcagccgaccccgtaaattctttaatttagtgtaggttctttcgtcggcccttcgtacggggtttctagtcgtcttccgtcccggctccgaagtcctggaccaaccgcggccctccctagacctatctctacgactccgaggtctagacggacgagctagacttaagttattgactagtctactaattaattactagaaacgttactaaagttcggtaacttccgtaacgttgggtaccgtttgggttacccggggcgggttaaaccgggtaacccgttaaagggtttccggaaccccggttaccgttaacggggttccgaaccggtaacccccgg

SEQ ID NO: 387914 - DNA, 668 bp, Homo sapiens
  misc_feature: GZ8MTXP01ADU0K.39.39.D06.1.454.CMB.2.raw
  modified_base (288)..(288): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaagtggtggagttgggtccgccagcccccgagggaaggggctggagttggattgggtagaaataaagtggacggaccggggggacaccgaaactacaaagngccgtccctcgaggggtcagtcaccatatctgcagacaagtaccaagaacccacttccacctgacgctcggacccctctgtcgacccgccgacggactcggccagtatacttagttgtgcgtagttagtttttgcgtaaggtcgttcgttacgggggcgttacgtccggtaacggttcgtagggggttacgaaaggggtactcggtaacggttccaagttccggtcctcccgtcgaacggtccccttaccgaacccgtaacggggcccctaagttccccgggttcccttccccccggttgggtccccgtccccgttggccccttacccggaaggggtaccccgcccgtaaccccgtaccggacgtaaccgccggtaaccg

SEQ ID NO: 387915 - DNA, 577 bp, Homo sapiens
  misc_feature: GZ8MTXP01CPOQX.39.39.D06.1.454.CMB.2.raw
  modified_base (230)..(230): a, c, t, g, unknown or other
  modified_base (266)..(266): a, c, t, g, unknown or other
  modified_base (298)..(298): a, c, t, g, unknown or other
  modified_base (443)..(443): a, c, t, g, unknown or other
  modified_base (517)..(517): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcacctatctcctgcactggaaccngcagtgacgttgtgtcttatatatgtctctgtcaangctatcagcagccgaccccgtaatcttaattntgtagttcttcgtcgcctgtacgggtttctagtctccttcgtcccgtctccgaagtctacgggaccaaccgaccggtccctacccgtagaaccctatccgtactacgacctcgaggtcaggaggacgaggtctagtacttagttntcgacagtctactaattaactacgtagaagtcaaatcggtaacttccgtacgttggtacgttcggttaccgggnggttaaccgggtaactaacggttccgtaaccgtcggttaacgtcccgaacggtaaccccg

SEQ ID NO: 387916 - DNA, 511 bp, Homo sapiens
  misc_feature: GZ8MTXP01EM436.39.39.D06.1.454.CMB.2.raw
  modified_base (229)..(229): a, c, t, g, unknown or other
  modified_base (266)..(266): a, c, t, g, unknown or other
  modified_base (359)..(359): a, c, t, g, unknown or other
  modified_base (369)..(369): a, c, t, g, unknown or other
  modified_base (374)..(374): a, c, t, g, unknown or other
  modified_base (400)..(400): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctctgtcaangcatcagcagccgaccccgtaaatcttaattatgtagttctttcgcgtcctgtacgggttctagtcgtcttctccggctcagtctggacaacncggcctcccngaccntctctacgactcgagtctgaggacgngctgacttattagtcgcagtctctatatactgtaatcaagtgtacttcctagttggtctggttcgggcggaggtaacctaggtcgaccgtcgttagtccgaacgtaacccg

SEQ ID NO: 387917 - DNA, 522 bp, Homo sapiens
  misc_feature: GZ8MTXP01CF0CG.39.39.D06.1.454.CMB.2.raw
  modified_base (263)..(265): a, c, t, g, unknown or other
  modified_base (353)..(353): a, c, t, g, unknown or other
  modified_base (408)..(408): a, c, t, g, unknown or other
  modified_base (432)..(432): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactgaaccagcagtgacgttgtgcttataatatgtctctgtcaannnatcagcacgcgaccccgtaatcttaattatgagttctttcgtcggcctgtacggttctagtcgtcttcgtccgctcaagtctgcaacncgcctcctgaccatctcagactcgagctgacggacgaggctagacttattacgtncgagctacattaatactagaagtnaatggtaacttccgaagttggtctgggttacggcgggaacgggtaacctaaaggttcgacccgtacgttaaggtccgaacgtaaccccgg

SEQ ID NO: 387918 - DNA, 565 bp, Homo sapiens
  misc_feature: GZ8MTXP01B55XE.39.39.D06.1.454.CMB.2.raw
  modified_base (227)..(227): a, c, t, g, unknown or other
  modified_base (241)..(241): a, c, t, g, unknown or other
  modified_base (251)..(251): a, c, t, g, unknown or other
  modified_base (266)..(266): a, c, t, g, unknown or other
  modified_base (303)..(303): a, c, t, g, unknown or other
  modified_base (353)..(353): a, c, t, g, unknown or other
  modified_base (359)..(359): a, c, t, g, unknown or other
  modified_base (367)..(367): a, c, t, g, unknown or other
  modified_base (381)..(381): a, c, t, g, unknown or other
  modified_base (398)..(398): a, c, t, g, unknown or other
  modified_base (401)..(401): a, c, t, g, unknown or other
  modified_base (412)..(412): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcacatctctgcactggaaccngcagtgacgttggntacttatatntgtctctgtaccaangctatcagcagccgaccccgtaaattctttaattagngtagttctttcgcgtcctgtacggtttctagtctctcgtcgctcgagtcngacacncgcctccnacatctacacgacnccgagctaggacgacgngtntagacttattntcgcagtcctactaattaactacgtagtaaacttacgtaaagttcggtaacttccgtacgttcgggtacgttcgggttccgggacgggttaacgggtaacctaaagggttccgtaaccccggttcgttacggtaacccgaacggtaaccccgg

SEQ ID NO: 387919 - DNA, 578 bp, Homo sapiens
  misc_feature: GZ8MTXP01CUUJB.39.39.D06.1.454.CMB.2.raw
  modified_base (246)..(246): a, c, t, g, unknown or other
  modified_base (271)..(271): a, c, t, g, unknown or other
  modified_base (340)..(340): a, c, t, g, unknown or other
  modified_base (351)..(351): a, c, t, g, unknown or other
  modified_base (356)..(356): a, c, t, g, unknown or other
  modified_base (362)..(362): a, c, t, g, unknown or other
  modified_base (371)..(371): a, c, t, g, unknown or other
  modified_base (383)..(383): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtcggaaccagcagtgacgttggtnacttataatatgtctctgttccaangcatcaggcagccaccccgtaaatcttaatttatgagttcttcgcgtcctgtcgggttcagtcgcttcnccgctcagtcngcacncgctcnacatctcanctcagctgagcnggctagacttagttatgactagtctactaattaactacgtagtaaacgttcctaaagttcgggttaacttcccgttaacggttgggttccgttcggggtttaccggggcgggttaaacggggttaacccgtaaacgggtttccggaaacccgggtttccggttaacgggttaacccgaaccgggtaacccccggg

SEQ ID NO: 387920 - DNA, 590 bp, Homo sapiens
  misc_feature: GZ8MTXP01A47P2.39.39.D06.1.454.CMB.2.raw
  modified_base (228)..(228): a, c, t, g, unknown or other
  modified_base (242)..(242): a, c, t, g, unknown or other
  modified_base (252)..(252): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagtgctctcaggacatctccaccatggcctgggctctgctgctcctcaccctctcactcagggcacagggtcctgggcccagtctggcctgacacagcctgcctccgtgtctgagactcctggacagtcgatcaccatctcctgcactggaaccngcagtgacgttggntcttataatntgtctctgtaccaangcattcaggcagccgaccccgtaaattctttaatttgtgtacgttctttcgcgccttgtacgggtttctagtcgtcttcgccgctcgagtctaggcaacgcggcctccctgacctatcctatacgactccgaggtctaggacggacgaggtcctagtacttaatttacgtcgactagtcctataattaacgtacgtagtaaacgtctaaagttcggtacttaccgtacgttggtacgtttcgggttaccgggacgggttaacgggtaacctacgggttaaccggtacccggttaccgttacgggtcccgaacggtaaccccgg

SEQ ID NO: 387921 - DNA, 596 bp, Homo sapiens
  misc_feature: GZ8MTXP01BV2XE.39.39.D06.1.454.CMB.2.raw
  modified_base (231)..(231): a, c, t, g, unknown or other
  modified_base (272)..(272): a, c, t, g, unknown or other
  modified_base (307)..(307): a, c, t, g, unknown or other
  modified_base (370)..(370): a, c, t, g, unknown or other
  modified_base (393)..(393): a, c, t, g, unknown or other
  modified_base (399)..(399): a, c, t, g, unknown or other
  modified_base (416)..(416): a, c, t, g, unknown or other
tcagtcgcactagtcacgaccggtgctcgatttagtgacatctcgcagttctttgggaggggtctcaggaggcagcgctctcaggacatctccaccatggcctgggctctgctgctcctcaccctcctcactcaggcacgagggtcctgggcccagtctggcctgacacagcctgccctcgtgtctgagactcctggacagtcgatcaccatcctctgcacgtaggaaccngcagtgacgttggtgcttataattatgtctctggttccaangcattcgagcagccgacccgtaaatcttaatttangatattccttcgtccgtcccctcggtagggtttctagtcgtcttcgtccggctccgaagtcgnggacaacgacggtccctacccgngacctntcctctaacgctaccgngctagacggacgacggctacggtaacttattaacgttgactacgacttacattaagtacctagtaaggtaactaaagttgggtaaaccttccgaacgttcggttcgttgggtttccggggaacgggtagggtaacccgttaaggttacccggttacccgtaaccgtttaacgggaacccg

SEQ ID NO: 387922 - DNA, 789 bp, Homo sapiens
  misc_feature: GZ8MTXP01ES24N.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcgggcggagatgaagtgggtggtaggttcgggtccgccgacggccccccgaaggggaaggggctaggaggttggagttggtagaaaataaagtggacgggaccgggggacaaccgaactaacaagtcgaccgtcccgtagacggggtacgacgtacaaccatactctgacagaacaaacgtaccaaagaaccctactttcctaccgtaggacggtctacgtaccccctcgttaggaccgacccggcccggaaccggtaaccgtccggaccctaattattaatttagttggtacgtacggttaaggtttagtttttaggacggtaggttagttcggggtttagggggtacggttaacgtccgggtacggttacgggtagggggtaacggaaagggttacggtacggtaaccggggttactaacgttccggttccctcccgttacgaacccggttcccctaaacccgaaccccggtaaacgggggtcccctaaccggttcccggttcccccgtttcccccgcgggtacccccgtcccgttccgggttcccttaccccgggaaggtaacccgtcccgtaccccgtacgggaaccgtaacggcccgaacccgggg

SEQ ID NO: 387923 - DNA, 725 bp, Homo sapiens
  misc_feature: GZ8MTXP01B7OO0.39.39.D06.1.454.CMB.2.raw
  modified_base (245)..(245): a, c, t, g, unknown or other
  modified_base (274)..(274): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggntacttataatatgtctccgtgtaccaacngctatcgaggcacggcccgaccccgtaaattactttaatttagtcggtacggtttcctttccggtccggtcccgtcggttacggggtttctaggtccgtctttccgtccggtcctccgtaagtccgtacgggacctaaccgacccgggtccctacccctacgaccctacttaccgtactaacggtacccttaccccgaggggtccgtaacggggaacgggaacccggaggtacccgttaaggtaactttaacgtttagttcgacgtagtccttactaaattaacttacgtaagtaaacgttacgtaaacgtttaacgggttacttacccgtacggttacgggtccgtttacggggttaccgggggaacgggttaaaccggggtaaaccgttaacgggtttccgggtaaccccggttccgttacggggaacccgttaaccggtaaccccggg

SEQ ID NO: 387924 - DNA, 527 bp, Homo sapiens
  misc_feature: GZ8MTXP01AP7YZ.39.39.D06.1.454.CMB.2.raw
  modified_base (227)..(227): a, c, t, g, unknown or other
  modified_base (302)..(302): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgggtctctaggacagtcgatcaccatctcctgcatggaaccngcagtgacgttggggtatgactatgtctctggtaccagcaatatccaggcacacgacccccaaatcatcatttangagtcagtaatcggcctcgagggtttcagtcgcttctctgctcaagtctagacaacacgccctcctgacctatctcgtcgggcctcgacggtcgacgaacggacgtagggcttaggtaatttacgtaacgtgctacgtctactatttgacctaaatcgaagtgaggtcttagtcgtacgttacggaggttcggaactaggtcacgtcgttactaaggttcaaccg

SEQ ID NO: 387925 - DNA, 637 bp, Homo sapiens
  misc_feature: GZ8MTXP01CKNFZ.39.39.D06.1.454.CMB.2.raw
  modified_base (227)..(227): a, c, t, g, unknown or other
  modified_base (241)..(241): a, c, t, g, unknown or other
  modified_base (264)..(264): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactggaaccngcagtgacgttgtncttataatatgtctctgtccaangcatcaggcagccaccccgtaaatcttaatttatgagttcttcgcgcctgtacggtttctagtcgtcttcgtcccggtctccgaagtcgacggtacccaacgtacccggtccctaccccgtagaccctatcctactaacgtacctccgaggtcgtaggacggacgagggtacttggtaacttagtttacgttcgacctagtccttacaattaacgtacgtacgtaaacgttactaaagttcggttaaacttcccgtacggttcggtaccggtttcgggtttaccgggggacggaaacgggggttaaacccgtaaacgggtttccggtaaccccggttacggttaacgggttcccgaaaccgggttaaccccgg

SEQ ID NO: 387926 - DNA, 662 bp, Homo sapiens
  misc_feature: GZ8MTXP01BQEDB.39.39.D06.1.454.CMB.2.raw
  modified_base (252)..(252): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataatntgtctctgtccaacngcattcaggcacgccgaccccgtaaacttctttaaatttatggtaggtttcctttcgtccggtcccttcgtacggggttttctagttccgtcttccgtcccggcctccgaagtctgggaccaacgaccggtccctccctcgacccatccgtcttacgaccttaccgaggtctaggaggacgacggtctagtaacttaatttagttcgacgtagtccctataacttacttaacgtagtaaagttacctaaagttcgggttaaccttcccgtaaacggttcgggtcgtttacggggtttaccgggggacgggggttaacgggtaaacccggttaagggtttaacccggtacccgggttacccggttaacggggttcccgaaccgggtaacccccggg

SEQ ID NO: 387927 - DNA, 565 bp, Homo sapiens
  misc_feature: GZ8MTXP01AW2TJ.39.39.D06.1.454.CMB.2.raw
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgttccaangcattcaggcagccgaccccgtaaatcttaatttatgtacgttctttcgcgcctcgtacggggtttctagtctcttctccggctcaagtctggcaacacggcctcctgacatctactagactccgagctagaggacgaggctagacttattatgacagtctactatactacgtaggtaactctaaatcgggtaaacttcccgtaaacgttcggtaccgtttcgggttaccgggcgggttaacgggtaaccctaaggttccggtaaccgtccgttaacgggtccaacggtaaccccgg

SEQ ID NO: 387928 - DNA, 613 bp, Homo sapiens
  misc_feature: GZ8MTXP01DI2QO.39.39.D06.1.454.CMB.2.raw
  modified_base (228)..(228): a, c, t, g, unknown or other
  modified_base (241)..(241): a, c, t, g, unknown or other
  modified_base (249)..(249): a, c, t, g, unknown or other
  modified_base (251)..(251): a, c, t, g, unknown or other
  modified_base (262)..(263): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcacatctcctgcactggaaaccngcagtgtagtgtntatatatntntctctgtacannctatcagcacgaccgaccctaacttacttaatttagtagtacgttctttcgtccgtccgtcgttacggttctagtcgtcttccgtccgctcgagtcgtacgaccaaccgaccgtccctacccgtacgacctacttcctactacgtacctaccgtacggtcgtagggacggacgacggtactagtaacgtttagtttagttcgactacgtcctactaattaacttaacgtaagtaaacgtacgtaaagttaacgtaacttaccgtacgttcgggtacgttcgggttaccgggcgggttaacggtaaccgtaacggttaacgtacccgtacgttacgtccgaaccgtaaccg

SEQ ID NO: 387929 - DNA, 633 bp, Homo sapiens
  misc_feature: GZ8MTXP01A62EF.39.39.D06.1.454.CMB.2.raw
  modified_base (228)..(228): a, c, t, g, unknown or other
  modified_base (243)..(243): a, c, t, g, unknown or other
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcatggaaccngcagtgacgttggtntcttataatatgtctcctagttaccaangctattcgagccagcccgaccccgtaaattctttaaagtttagtagtacggttcctttcggtacggtccccttggtacggggtttctagtccgtccttccgtcccggtctccgaacgtccgtaggaccaaccgtaccggtccccttacccgtcgaacctacttctcgtaacgtacctccgaaggtcgtaggacggacgacggtctacggtaacttagtttacgtcgtacaacgtctactaattaactacgtagtaaacgtctaaagtcgtaacttccgtattcggtcgttcgggttccggacgggttaccgggtaacgtaaggttccggacccggttccgttacgggtccaacggaaccccg

SEQ ID NO: 387930 - DNA, 626 bp, Homo sapiens
  misc_feature: GZ8MTXP01BNW78.39.39.D06.1.454.CMB.2.raw
  modified_base (229)..(229): a, c, t, g, unknown or other
  modified_base (244)..(244): a, c, t, g, unknown or other
  modified_base (273)..(273): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtntacttataatatgtctccgtgtaccaacngcatcgagcagcccgaccctaaattcttaattatgtacgttctttcgcgcctgtacgggtttcagtcgtcttcgccgctcagtcgtggacaaccgccggtccctacccgtacgaccctacttcctacgtaacgtaccctacccgtagggtacctacgggaacgggaaccgtacggtcgttacgttaactttagttttaagtcgactaacgtccttactaattaaacgttacgtaagtaacgtacctaaagttggtaaccttcggtacgttcggtacgttgggttaccggggacgggttaacggtaacctaaggtttccggacccggtacttagggtaaccaacggtaaccccg

SEQ ID NO: 387931 - DNA, 633 bp, Homo sapiens
  misc_feature: GZ8MTXP01DJTFH.39.39.D06.1.454.CMB.2.raw
  modified_base (227)..(227): a, c, t, g, unknown or other
  modified_base (242)..(242): a, c, t, g, unknown or other
  modified_base (270)..(270): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccatctcctgcactggaaccngcagtgacgttggtntcttaatatatgtctctggttaccaacngctatcgaggcagcccgaccccgtaaatcttaaatttagtgtacgttctttcgccgtcctcggtacgggtttctagtcgtcttcgtccggtctccgagtccgtggaccaaccgacggtccctccctacgacctattcctacgtaacgtaccctacccgagggtccttacgggaacggaaccggagggtaccttacggttaaacctttaagttttaacgtttcgaccgtaagttccttaactaatttaacgttaacgtagtaaacgttcaaaaggttcggtaacttccgtaacgttggtacgttgggttaccgggcgggaagggtaacctaaggttcgaccgtcgttaggtccaacgtaacccg

SEQ ID NO: 387932 - DNA, 592 bp, Homo sapiens
  misc_feature: GZ8MTXP01DS2SD.39.39.D06.1.454.CMB.2.raw
  modified_base (229)..(229): a, c, t, g, unknown or other
  modified_base (243)..(243): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggntacttatatatgtctctgtccaangcattcagcagcccgacccctaaattctttaatttatgtacgttctttcgccgtccctcgtacgggtttctagtcgtcttcgtccgctcgaagtctgacaacgcgcctccctgacctatctactacgacctcgaggctaggagacgagctagtacttattatgcacgctacaattaactacgtagtaaacgtacgtaaagttcggttaacttcctacggttcgggtcgtttacggggtttccgggacgggttaaaccgggtaaccgttaacggtttccggtaaccccggttaccgttacgggtaacccgaacccggtaaccccgg

SEQ ID NO: 387933 - DNA, 614 bp, Homo sapiens
  misc_feature: GZ8MTXP01C2LLI.39.39.D06.1.454.CMB.2.raw
  modified_base (200)..(200): a, c, t, g, unknown or other
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacngtcgatcaccatctcctgcactggaaccagcagtgacgttgtgtcttataatatgtctctgttccaanagcattcagcagccgaccccgtaaatcttaaattatgacgttctttcgtcgtcctcgtacggggtttctagtcgtcttccgtaccgctccgaagtccgtggacaaccgcgtccctccctgacctatcctactacgacctacgacggtctggaacggacgtacgggtcttacggtaactttaagtttaacgttcgaccgtaacgtccctaacgtaattaaacgtaacgttagtaaagtccgttaaagtaacggtttacttacccgtagttgggttacctcgggttacgggcgggttaaacggaaccgtaagttccgaaccgtcgttaacggtccgaacggtaacccg

SEQ ID NO: 387934 - DNA, 612 bp, Homo sapiens
  misc_feature: GZ8MTXP01CWR32.39.39.D06.1.454.CMB.2.raw
  modified_base (228)..(228): a, c, t, g, unknown or other
  modified_base (242)..(242): a, c, t, g, unknown or other
  modified_base (250)..(250): a, c, t, g, unknown or other
  modified_base (252)..(252): a, c, t, g, unknown or other
  modified_base (263)..(264): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgtcgttgtntatatatntntctctgtacanncatcagcacgccaccctaaatacttaattatgtagttcttcgtcgtctcgtacggttctagtcgtctctcgctcgatctagacaacgccgtccctcctacacctatctactacgtacctacgacgtcgtaggacggacgacgtactagtaactttagtttacgttcgactacgtcttaactaattaaacgttacgtaaggttaaacgttaacgtaaagtttcggtaaccttacccgtacgttcgggtaccgttacggggttacccggggacgggttaaacgggtaacccggttaaacggttccgggtaacccggttaccgttaacgggtaacccgaacggtaaccccg

SEQ ID NO: 387935 - DNA, 529 bp, Homo sapiens
  misc_feature: GZ8MTXP01DYOC0.39.39.D06.1.454.CMB.2.raw
  modified_base (305)..(305): a, c, t, g, unknown or other
  modified_base (365)..(365): a, c, t, g, unknown or other
  modified_base (374)..(374): a, c, t, g, unknown or other
  modified_base (400)..(400): a, c, t, g, unknown or other
  modified_base (411)..(411): a, c, t, g, unknown or other
  modified_base (437)..(437): a, c, t, g, unknown or other
  modified_base (439)..(439): a, c, t, g, unknown or other
  modified_base (447)..(447): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccagcagtgacgttggtgcttaataatatgtctcctggttaccaaacagcatcaggcagcaccccgaaatcttaatttangtaggttctttcgcggccctgtacggggtttcagtcgtcttctaccggctccaaagttcnggacaaacncggccttcccagacccatctacgtanactccaggtcngagacgagctagacttagttatgcantnatatatanaagtacaataagtacttactacgttgtcgtgttcggcggacggaacgtacgtaacgtaccgtacgttacgtcgaacgaaccg

SEQ ID NO: 387936 - DNA, 618 bp, Homo sapiens
  misc_feature: GZ8MTXP01EOLE4.39.39.D06.1.454.CMB.2.raw
  modified_base (297)..(297): a, c, t, g, unknown or other
  modified_base (434)..(434): a, c, t, g, unknown or other
  modified_base (565)..(565): a, c, t, g, unknown or other
  modified_base (588)..(588): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatgaagtgggtggagttgggtccgccgacgcccccgaggggaagggctggagttggattggtagaaataaagtggacggaccgggggacaaccaactacaatcgcgtcccncgagggtcgagtcacatatctgacagaacaagtaccaaacgaaccctacttcctccgtagacgctcgtacccctcgtcgtcgaccgccgacgactcggactatactattagttgtgtcgtagttgtttgcgtaggtnttcggttgggggacgttaacgtcggtacgttcggtaggggtacgaagggtacgtcggacgggttctacgttcgtcctccgtcaccgtccctaccgaccgtaacgggcccaacgttccggttccctccccgnggccctacccgttgcccttacgnggactcctaaccgcgacgaacgcgaaccgg

SEQ ID NO: 387937 - DNA, 595 bp, Homo sapiens
  misc_feature: GZ8MTXP01D591X.39.39.D06.1.454.CMB.2.raw
  modified_base (228)..(228): a, c, t, g, unknown or other
  modified_base (271)..(271): a, c, t, g, unknown or other
  modified_base (389)..(389): a, c, t, g, unknown or other
  modified_base (393)..(393): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccngcagtgacgttggtgcttataatatgtctcctggttccaaacngcattcaggcagccgaccccgaaatctttaattatgaggttctttcgtcgcctgtacggggtttctagtcgtcttcgtcccgctccaagtctggacaacacggcctccctgaccatcnctanactccgagtctaggaggacgacggctagacgttatttagttacgctagtcctacaattaactacgttagaaacggttctaaagttcggttaacttcccgtaagttcgggtaccgtggggtttacccgggcggggttaaacgggtaaccccgtaaaaggtttccggaacccggttccggttaggttcccgaacggtaaccccg

SEQ ID NO: 387938 - DNA, 762 bp, Homo sapiens
  misc_feature: GZ8MTXP01C2W15.39.39.D06.1.454.CMB.2.raw
  modified_base (234)..(234): a, c, t, g, unknown or other
  modified_base (249)..(249): a, c, t, g, unknown or other
  modified_base (275)..(275): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacgagggtcctgggcccagtctggcctgacacagcctgcctccgtgtctgagacctccgtggacagtcgatcaccatctcctgcacgtggaaccngcagtgacgttggtntcttaataatatgtctctgtacaacngctatcaggcacggacccgaaccccgtaaatttactttaaagttttatcggtacggtttcctttacggtcccggtccctttaggttacccggggtttttcctacggtttcccgtaccgtttcccgtaacccgggtccttaaccgtaaagtcccgtacggtaacccaacccgtcccggtcccctccccgtagaaccctcttaccgtactacgacccttaccgaagggtcctaaggggaacggaacgtagggtacccttaggttaactttaacgtttacgttacgaccgtaaacgtccttaacgtaaatttaaacgttaccgtaaaggttaaacgtaccttaaaggttcccggttaaacttaccggttacgttcggggttacgtttccgggggtttaccggggaccgggttaaaccggggtaaacccttaaagggttttcccggaaacccggtttcccggttaaagggtccccgaaccgggtaaccccg

SEQ ID NO: 387939 - DNA, 567 bp, Homo sapiens
  misc_feature: GZ8MTXP01A0XE9.39.39.D06.1.454.CMB.2.raw
  modified_base (400)..(400): a, c, t, g, unknown or other
  modified_base (474)..(474): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcaggtgacggttggtgtcttataatatgtcttccgtggttccaacagctattcaggcagccgaccccgtaaattctttaaatttagtgtacggttctttcggtccggtccctcgtacggggtttctagtcgtcttcgtccgctccgaagtctggcaacgacgcctcccngaccatcctctacgacctcccgaggctagaggacgagtctagacgttattattgacagtcctacgtataacgtntagtagtactaagtggtacttcccgagttggcgttgggttcggcgggacggtaaccaggttcgacccggtcttacgggtcaacgtaaccccgg

SEQ ID NO: 387940 - DNA, 676 bp, Homo sapiens
  misc_feature: GZ8MTXP01CHXYU.39.39.D06.1.454.CMB.2.raw
  modified_base (212)..(212): a, c, t, g, unknown or other
  modified_base (227)..(227): a, c, t, g, unknown or other
  modified_base (243)..(243): a, c, t, g, unknown or other
  modified_base (274)..(274): a, c, t, g, unknown or other
  modified_base (601)..(601): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcacatcncctgcactggaaccngcagtgtacggttgtntacttaataatatgtcctccgtagtaccaangctatcgagcacggccgacccctaaattcttaatttagtgtacggttctttcggcgccttagtacgggtttcagtcgtcttcgcccggctccgaagtccgtcggacctaaaccggcccggtccctccctacgtaccctacgttcctacgtaaccgtaccgttacccgaacgggtcgtagggaccgggaaccgtaacgggtcttaacggtaaacctttaagtttacgttaccggactacgtacccttaactaaatttacgtacgttaagaaaccgttataaaggttcgttaaacacccgttgttcgggtccgttggggttacccgggngggttaaacccgggtaacttaaaacgggttccgtaaccccggttcggttaaacggtcccgaacccggtaacccgg

SEQ ID NO: 387941 - DNA, 599 bp, Homo sapiens
  misc_feature: GZ8MTXP01DMP9J.39.39.D06.1.454.CMB.2.raw
  modified_base (229)..(229): a, c, t, g, unknown or other
  modified_base (404)..(404): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttaataatatgtctcctgttccaacagctattcgaggcagccgaccccgaaaattcttaaatttactgtaggttctttcgcgcctcgtacggggtttcagtcgtcttcgtcccggctccgaaagtctagggacctaacgcggcctccctcgacctatcncttagcctccaggtcctgggacgacgacggtctaggtacttaatttagtcgactagtctactattaaacttactaggtaaacgtctaaagttcggttaacttccgtaacgtttgggtacctttggggttaaccggggcgggttaaacggaacctaaggtttcgaccggttccgttaaggtccgaacggtaacccg

SEQ ID NO: 387942 - DNA, 499 bp, Homo sapiens
  misc_feature: GZ8MTXP01AOA3K.39.39.D06.1.454.CMB.2.raw
  modified_base (269)..(269): a, c, t, g, unknown or other
  modified_base (434)..(434): a, c, t, g, unknown or other
  modified_base (492)..(492): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacngcattcaggcagcgccccgaaactcttaatttatgtaggtctttcgcggcctcgacggggtttctagtcgtcttctccggctccaagtctggcaacacggcctccctgaccatctctagactccaggctgaggcgaggctgacttattatgcagctcatatactnaagtcaatggtattcattggctgttcggcggagggccaagttcgaccgtcttaggtcngaacccg

SEQ ID NO: 387943 - DNA, 583 bp, Homo sapiens
  misc_feature: GZ8MTXP01EH4MS.39.39.D06.1.454.CMB.2.raw
  modified_base (229)..(229): a, c, t, g, unknown or other
  modified_base (254)..(254): a, c, t, g, unknown or other
  modified_base (268)..(269): a, c, t, g, unknown or other
  modified_base (273)..(273): a, c, t, g, unknown or other
  modified_base (419)..(419): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataatntgtctctgtccaanncatnagcagccacccgaaatcttaatttatgtaggttctttcgtccgtcctcgtacgggtttctagtcgtcttcctccggctcgaaagtctaggccaaaccgcggcctcccgtagaccctgtctctacgacctccgagctggaggaccgnggtacctgtaacttattattgcagtctacattaatcgtagtaagtactaagttggttacttccgtacgttcgggtctttacggggttcgggacggggttaacgggtaaccgtaaacgggtttcgtaccccggttacgttaacgggttccgaacggtaaccccgg

SEQ ID NO: 387944 - DNA, 634 bp, Homo sapiens
  misc_feature: GZ8MTXP01EE1SI.39.39.D06.1.454.CMB.2.raw
  modified_base (246)..(246): a, c, t, g, unknown or other
  modified_base (279)..(279): a, c, t, g, unknown or other
  modified_base (545)..(545): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtaggaaccagcagtgacgttggngtcttaataatatgtccttcctggttaccaaangctattcgaggcacgcccgaaccccgtaaattctttaaattatggtacggttcttttaccggccggcccttggtacggggtttcctaggtccgtccttccgtacccgggactccggaaagttccgtagggaccaaaccgcccgggtcccttccctagaccctattccgtactaacgaccttacccggaggtcctagggaacggaccgagtctagaacttattagtgactacgctacattactactaggaactcaagtaaggttacnccgtaaggttcggtacgttcgggttacgggcgggaacggtaacctaaggttccgtaacccggtgttacggtaacgaaccggaaccccgg

SEQ ID NO: 387945 - DNA, 628 bp, Homo sapiens
  misc_feature: GZ8MTXP01AENLK.39.39.D06.1.454.CMB.2.raw
  modified_base (229)..(229): a, c, t, g, unknown or other
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctcgtgtctgagactcctggacagtcgatcaccatctcctgcactggaaccngcagtgacgttggtgtcttataatatgtctcgtgtaccaangctattcaggcacgcccgaccccgtaaattctttaaatttatggtacggttctttacggtccggtcccttcgtacggggtttctaggtcgtccttcgtcccggtctccgtagtctgggaccaaccgacggtccctccctagacctactctacgtacgcctacccgaggcgtggaacggtacgacggtctagtaactttattagttcgacctatcttactaagttaactacgtagtaagttaccgtaaagttcggtaaacttccgaacggttcggtacggttcggttacggggacgggaacgggtaacccgtaaaggttccggtaacccgtcgttacggtaaccgaacggtaaccccgg

SEQ ID NO: 387946 - DNA, 643 bp, Homo sapiens
  misc_feature: GZ8MTXP01A2AKL.39.39.D06.1.454.CMB.2.raw
  modified_base (225)..(225): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactctggacagtcatcacatctcctgcactggaaccngcagtgacgttggtgcttataatatgtctcctggttaccaanagctattcaggcagccgaccccgaaacttctttaatttagtgacggtttctttccgtcgtcccttcgtagggtttctagtcgtcttctccggctccgaagtctaggacaacgacggcctccctagaccctatctactagactaccgaggtctaggacggaacgcgggtactaggtaacctttagtttaacgttcgtaccgtaacggtccttaaccgtaatttaaaccgttaccgttaaggggttaaacttacgtaaaaccggttgggttaaacttccccgtaaacgttcgggtcgtttcgggttaccgggcggggttaacgggtaaccgtaaggtttcggacccgttaccgttacgggtccgaacggtaaccccgg

SEQ ID NO: 387947 - DNA, 694 bp, Homo sapiens
  misc_feature: GZ8MTXP01EDCVV.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgccctcccgtcggcggagatggaagtgggtggtaggttcgggtccgccgacggcccccgaggggaaggggctaggaggttggagttggtagtaaagtaaagtggaacgggaccggggggacaaccgaaactacaaatcgccgtccctgaggggtcgagtcacatatctgcagacaaacgtccaaagaaccctacttcctccctagacgctcgaccccctcgtcgtcgacccgccgccgggactccggacctatattattagttggtgacgtagttagttttgacgtaggtagttcggttagggggcgttagtacggtacggttcggtcgggggtacgaaggggatcgtacggtctaacgttccggtcctcccgttcgaccgtcccgtacccgaacccgtaccggggcccctaacgttccccgggttccccgtttccccccggttgggtcccccgtcccgttccgcccgttacccgaacgggacccgcccgtaaccccgtccggaacgaaccgaaccgaacccggg

SEQ ID NO: 387948 - DNA, 610 bp, Homo sapiens
  misc_feature: GZ8MTXP01EUXS6.39.39.D06.1.454.CMB.2.raw
  modified_base (230)..(230): a, c, t, g, unknown or other
  modified_base (278)..(278): a, c, t, g, unknown or other
  modified_base (411)..(411): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctctgcactggaaccngcagtgtacgttggtgtacttaataatatgtcttcctaggttaccaanagctattcgaggcacgcccgaccccgtaaacttactttaatttagtgtacggttcctttcgtccggtccctcggttacggggtttctagtccgtcttcccgtcccggtctccgtaagttctacgggtaaaccnccggtccctcctacgaccctactctcgtacacctccgtaggctaggacggacgaggtctagtacttagttattggctagctcaattatacgtagtaatactaagtgtaactccttaggtcggttggtcggttcgggacgggacggttaccgtaaggttccggtaaccgttcgtacggccgtaaccggcccgtaaccggg

SEQ ID NO: 387949 - DNA, 642 bp, Homo sapiens
  misc_feature: GZ8MTXP01DIPQG.39.39.D06.1.454.CMB.2.raw
  modified_base (227)..(227): a, c, t, g, unknown or other
  modified_base (240)..(240): a, c, t, g, unknown or other
  modified_base (242)..(242): a, c, t, g, unknown or other
  modified_base (250)..(250): a, c, t, g, unknown or other
  modified_base (265)..(266): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcacatctctgcactggaaccngcagtgacgttgntnttataatntgtctctgtaccaannctatcagcacgccgaccctaaattctttaatttatgtacgttctttcgccgtcctgtacgggtttctagtcgtcttcgtacccggtctcccgaagtccgtacggaccaaacccgtccgggtccctaccccgtagaaccctacgttcctactaacgacctaccgacggtccgtagggaacggacgaaggtccttaaggtaactttaagtttacgttgacctaacgtccttactaaattaactaacgtaggtaaacgttcgtaaagttcgttaacttaccgtacgttcggtcgttcgggttccggggacgggttaaacgggtaaccctaaaggtttccgtaacccggttcgtttaacggtcccgaacggtaaccccgg

SEQ ID NO: 387950 - DNA, 638 bp, Homo sapiens
  misc_feature: GZ8MTXP01CTYV1.39.39.D06.1.454.CMB.2.raw
  modified_base (242)..(242): a, c, t, g, unknown or other
  modified_base (268)..(268): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctctcactcagggcacagggtcctgggcccagtctggcctgacacagcctgcctcgtgtctgagactcctggacagtcgatcacatctcctgcactagaaccagcagtgacgttggtnacttataatatgtctcgtgtaccaangctattcaggcacgccgaccccgtaaattcttaatttatggtacgttctttccggtccgcccttgtacggggtttctacgtccgtcttcccgtaccgggtcctccggaaacgttccgtacgggaccctaaccgacccggtccccttacccgtagaaccctattcctacgtaacgtaccctaccgaagggtcctagggaacgggaccgtacggtacttacggtactttaagtttacgttcgacgtagtcctacttaacttaaagttacctaaagggtaactacctaaagttcggtaacttcccgtagttcggtacgttcggttcgggagggttacggaactaaggtcgacgtcgacgtcgaacgtaacccg

SEQ ID NO: 387951 - DNA, 573 bp, Homo sapiens
  misc_feature: GZ8MTXP01A0FQK.39.39.D06.1.454.CMB.2.raw
  modified_base (229)..(229): a, c, t, g, unknown or other
  modified_base (244)..(244): a, c, t, g, unknown or other
  modified_base (309)..(309): a, c, t, g, unknown or other
  modified_base (436)..(436): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtncttataatatgtctctggttccaacagctattcaggcacgccgaccccgaaattcttaaatttangtaggttctttcgtcgccctgtacggggtttctagtcgtcttcgccggtctccgaagtctagggaccaaccgaccgggtccctccctgacctactctcgtacgacctccgaggtctaggacggacgnggctgactattatgcagctacatatacgtagaacgtctaaagtggtaacttccgtaacgttgggtcgtagggttccggggacggttacggggaactaaggttcgacccggttcgttacgggtccaacggtaaccccg

SEQ ID NO: 387952 - DNA, 546 bp, Homo sapiens
  misc_feature: GZ8MTXP01C9GUU.39.39.D06.1.454.CMB.2.raw
  modified_base (229)..(229): a, c, t, g, unknown or other
  modified_base (244)..(244): a, c, t, g, unknown or other
  modified_base (253)..(253): a, c, t, g, unknown or other
  modified_base (268)..(268): a, c, t, g, unknown or other
  modified_base (372)..(372): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctcctgcactggaaccngcagtgacgttggtncttataatntgtctctgtaccaangcatcaggcagccgaccccgtaaattcttaatttagtgtacgtttctttcgcgtcctcgtacgggttcagtctcttcgccgctcagtctgacaacgcgcctccnacatcactagacctccgaggtcgtggggacaggtctagtaacttatttatcggactacgtctacattacgtactagtaaagttactaagttcggtaactccgagttggccgtttgggtcgggacggttaggaccctaaggttccgccgttacgtaggttacaacgccgtaacgg

SEQ ID NO: 387953 - DNA, 582 bp, Homo sapiens
  misc_feature: GZ8MTXP01DKU1Q.39.39.D06.1.454.CMB.2.raw
  modified_base (229)..(229): a, c, t, g, unknown or other
  modified_base (269)..(269): a, c, t, g, unknown or other
  modified_base (436)..(436): a, c, t, g, unknown or other
  modified_base (449)..(449): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataatatgtctctgttccaangcatcaggcagccgaccccgtaaatcttaatttatgtacggttctttcgtcgcctcgtacgggtttctagtcgtcttcgtcccgctccgaagtcgtaggacaaccgacggtcctccctagaccatctactagacctacaggctaggagtacgaggctagacttattnttagctagcctanaattaatactagaagtctaaagttcggtaacttcccgtaacgttggtaccgttgggttaccgggcgggttaacggggtaaacctaaaggtttcggtaacccgttcgttaacgggtcccgaacgggtaaccccg

SEQ ID NO: 387954 - DNA, 574 bp, Homo sapiens
  misc_feature: GZ8MTXP01DG6WY.39.39.D06.1.454.CMB.2.raw
  modified_base (229)..(229): a, c, t, g, unknown or other
  modified_base (244)..(244): a, c, t, g, unknown or other
  modified_base (267)..(267): a, c, t, g, unknown or other
  modified_base (302)..(302): a, c, t, g, unknown or other
  modified_base (397)..(397): a, c, t, g, unknown or other
  modified_base (459)..(459): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatcctcctgcactggaaccngcagtgacgttggtntcttatatatgtctctgtccaangcatcagcagccgaccccgtaaattcttaaatttntgtacggttctttccgtcggcctcgtacggggtttctagtcgtcttcgtcccggctccgtaagtcctggaccaaccgcggtccctccctgacctntcctctagtacctacgaggtcctaggacggacgagactagtaacttattagttgcagtcctnaattaactacgtagaagtcaagttggtacttccgtagttcggtcgttcgggttacgggcgggttaacgggtaacctaaggttcggacccgtcgttacgggtccaacggtaacccg

SEQ ID NO: 387955 - DNA, 647 bp, Homo sapiens
  misc_feature: GZ8MTXP01C2MLA.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatgaagtgggtggagttcgggtccgccacgcccccgaggggaacggggctggagttggagttggtagaaataaagtggaacggaccgggggacaaccgaactaacaatcgacgtccctcgaggggtcgagtccaccatatctgacagaacaagtaccaaagaacccacttcctccctagacgctcgacccctctgtcgacccgccgccggactcggacctatactattattgtgtacgtagttagttttgcgtaggtagttcggttgggggtcgtagtcggtacgttcggtaggggtacgaaggggtactcgtacgggttcacgttccgtacctccctcgaaccgtcccctacccaaccgaaccgggtcccctaacgttcccggttcccttcccccggttggcccgtccccgttcgccgttaccgaacgggacgccgtacccgccggagccgccgaaccgg

SEQ ID NO: 387956 - DNA, 596 bp, Homo sapiens
  misc_feature: GZ8MTXP01A5UBU.39.39.D06.1.454.CMB.2.raw
  modified_base (226)..(226): a, c, t, g, unknown or other
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactgaaccngcagtgacgttggtgtcttataatatgtctcctggttccaangcattcaggcagccgaccccgtaaattctttaatttatgtaggttcttcgtccggcctcgtacggggtttctagtcgtccttcgtcccggtctccgaaagtccgtaggaccaaccgaccggtcccttccctagaccctatcctactagaccttaccgaggtcctggaggacgaggtctagacgttattatgacacgtctctaatactacgtagtaattacgaagttggtaacttccgtacgttcggtacgttcgggttaccgggcgggttaacgggtaacctaagggttccgaacccggtaccgttacgggtccgaacggtaaccccg

SEQ ID NO: 387957 - DNA, 742 bp, Homo sapiens
  misc_feature: GZ8MTXP01CG7R2.39.39.D06.1.454.CMB.2.raw
  modified_base (520)..(520): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacgagggtcctgggcccagtctggcctgacacagcctgcctccgtgtctgacgtactccgtggacagtcgatcactatctcctgacacgtacggaaccagacgtaggtaggtacggtttgggtacttaactttaaagttaatacgttcgttccgttaccgttacggttaccaaacgacgtactagttaccgaggaccacggaccccgaaccccgttaaaattcgtttaaaatttgtcggttaacgggtttcctttaccgggtaccggtcccgttacgggttaacggggttttacctacgttccgtccctttccggcccggttacctaaccgttaaacgtccgtacggaccaaaccgtcccggtcctacccgtagaaccctntacctacgtaacgacctacgaacggcgtacggacggtaacgcgtacgttaagttaacgttactttaagtcggaactacgtacctataattaaaccgacgtaagtaaactagtaaacgtggttaaccttacctaggttcggttcgtacgggttccggggacgttaaccgggggtaactaaacgtttccggacccgttacgttacggtccgaacgtaaccccgg

SEQ ID NO: 387958 - DNA, 683 bp, Homo sapiens
  misc_feature: GZ8MTXP01D2P2U.39.39.D06.1.454.CMB.2.raw
  modified_base (462)..(462): a, c, t, g, unknown or other
  modified_base (654)..(654): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatgaagtggtggagttcgggtccgccgacgcccccgagggaaggggctggagttggagttggtagtaaaagtaaagtggaacgggacccgggggacaaaccgaaacgtaacaaagtcggaccgtccccgtacggacggggtcgtacgtaccaaccgtataactcgtacgacagaaaccgaaacgtacccaaacgtaacccctaacttccctccgttagacgtctacgaccctctacggtcgacccgccgaccggactcggacctatactattgtgngtacgtagttgtttgacgtagtagttcggtggggtacgtagtcggtacgtcggtacgggtacgaagggtctacggtacgtctacgtccgccttccgacgaccgtccctaccgaacccggtaaccggccctaacgtttcccgttccccgtttccccgcggtccccgtcccgttacgcgttacccgaaggtccnccgtacccgacgacgtccgcgaacccggg

SEQ ID NO: 387959 - DNA, 562 bp, Homo sapiens
  misc_feature: GZ8MTXP01DFJGJ.39.39.D06.1.454.CMB.2.raw
  modified_base (242)..(242): a, c, t, g, unknown or other
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctcgtgtctgagactcctggacagtcgatcaccatctcctgcactggaaccagcagtgacggttggngtacttataatatgtctctgtaccaangcatcagcagccgaccctaatcttaattatgtagttcttcgcgcctcgtaggttcagtctctcgtaccgctcaagtctcggacaaccgccgtcctcccgagacctactcgtactacgtaccacgacgctaggacggacgagtctagtacgttaatttagtcgacagccttaactaacttataacgtagtaaacgttcgaaagttcgttaacttccgtaacgttgggtacgtttcgggttcgggaccgggaagggtaacctaagttcgaaccgtcgttagtaaccgcgaacccg

SEQ ID NO: 387960 - DNA, 554 bp, Homo sapiens
  misc_feature: GZ8MTXP01ASSQP.39.39.D06.1.454.CMB.2.raw
  modified_base (252)..(252): a, c, t, g, unknown or other
  modified_base (264)..(264): a, c, t, g, unknown or other
  modified_base (382)..(382): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatatngtctctgtccanagcatcaggcagccgaccccgaaacttctttaatttatgtagttctttcggtcgtccctgtacgggtttctagtcgtcttctcccggctccgaagtcctgaccaacgcggcctacccncgaccatcctactagctacccgagtctcgacggacgaaggtctgacttattagtgacagtctacaatataactagaatacaagttgtacttacgacgttcggtcgtggttcgggcggaacgggtaacccgtaggttccgtaccggtcgttacgggtccgaacggtaaccccg

SEQ ID NO: 387961 - DNA, 669 bp, Homo sapiens
  misc_feature: GZ8MTXP01CJ2R2.39.39.D06.1.454.CMB.2.raw
  modified_base (222)..(222): a, c, t, g, unknown or other
  modified_base (229)..(229): a, c, t, g, unknown or other
  modified_base (243)..(243): a, c, t, g, unknown or other
  modified_base (253)..(253): a, c, t, g, unknown or other
  modified_base (265)..(265): a, c, t, g, unknown or other
  modified_base (297)..(297): a, c, t, g, unknown or other
  modified_base (301)..(301): a, c, t, g, unknown or other
  modified_base (668)..(668): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcacnggaaccngcagtgacgttggntacttatatntgtctctgacangcaccagccaaacgccccaatcatgtatttangagnagagcgagctagtattatactgacagtctataaatactaacaagtcaagaccagtctacttcgttggtaggttaacgtcggggacgggaacgggacccaaaggtcctacggtacccgttacccgtaagggggtaccccaaacggaccccgaaacggggtcccctacccggtccccccgttacgggttacccctacccgttacccgtttccccggttaacccccctcccccgtttaacccttcccgttaaaccggtttaccggggttccggaaccggttaaccgggttcggggaacccggggcccgggggttccgtaccgggggtaacggaaacccggggtcccgggttaaacgtaacggttaacggng

SEQ ID NO: 387962 - DNA, 680 bp, Homo sapiens
  misc_feature: GZ8MTXP01CK8EP.39.39.D06.1.454.CMB.2.raw
  modified_base (246)..(246): a, c, t, g, unknown or other
  modified_base (279)..(279): a, c, t, g, unknown or other
  modified_base (474)..(474): a, c, t, g, unknown or other
tcagtcgcactagtcacgaccggtgctcgatttagtgacatctcgcagttcgtttgggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcatcacatcctcctgcactaggaaccagcagtgacgttggtanacttaataatatcgtcttccgtgttaccaaacngctattcaggacacggcccgtaacccccgtaaaattactttaaaagtttagtaggttacggttccgtttccggtaccgggccccttcggtaacgggggttttcctacggttccgtccctttccggtaaccccgggtacctaaccgaaacggtttccacggggaaccaaaccgtacccgggtcccctaccccgtanaaccctactctacaacgtacctacccgaggtcctagggaacgggaacgttaggccttagaacgtttaatttacggtgactagaccttaagaattaacgtacgtaagtaacgtagtaagttcgtaaccttccgtaaggttcgtcgtcgggttacgggcgggaacggtaactaggttcgacccgtcggttacgtccgaacgtaacccg

SEQ ID NO: 387963 - DNA, 565 bp, Homo sapiens
  misc_feature: GZ8MTXP01CCYVJ.39.39.D06.1.454.CMB.2.raw
  modified_base (268)..(268): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataatatgtctcctggttccaacngcattcaggcagccaccccgaaatcttaaatttatgagttctttcgcgcccttgtacgggtttcagtcgcttctccggctccagtctggcaacgcggcctcctgaccatctctagactcgaggctgacggacgaggctagacttattagttgaccagtcctacataacttactagtaaagtcaaagttcggtaaacttcccgaacgttggtcgttacggttccggggcgggttaacggggtaaccctaaagggtttccggaaccggttcccgttaaggggtccaacgggtaaccccg

SEQ ID NO: 387964 - DNA, 745 bp, Homo sapiens
  misc_feature: GZ8MTXP01EG8YF.39.39.D06.1.454.CMB.2.raw
  modified_base (232)..(232): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcatcacctatctcctgcacgtggaaccngcagtgtacgttggtgtacttaataattatcgtccttccgtacggttaccaaacgagtactatttacgaggaccacggacccgtaacccccgtaaaatttccgtttaaattttagtcggtaacggtttcctttaccggtccggtcccccgtttagttaccgggggttttacctacggtccgttaccctttcccgtccccgggtccttaacccgtaaacgttcgttcggaccgtaacccgacccgggtcccttcccctacgaccctagttccctacgtacgaccttaccgagggttcaggaacggtaccgaggtacttaggtaactttagttacgttcggaccttacgcttaactaacttaacggttaaccttacggaaaacgtttacgtaaagtttaagttaacccgttacccgttggttacgggtccgtttaacggggttccggggacgggttaacggtaaccgtaaagggtttcgacccggttcgttaacggtccgaacggtaaccccggg

SEQ ID NO: 387965 - DNA, 674 bp, Homo sapiens
  misc_feature: GZ8MTXP01BAX6D.39.39.D06.1.454.CMB.2.raw
  modified_base (244)..(244): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtncttataatatgtctcgtgtccaacagctattcaggcacgcccgaccccgtaaacttctttaaatttagtgtacggttccttttccggtccggcccttcggtacgggggtttctacggttcgtcctttccgtcccgggtactcccgtaaagttccgtacgggacctaaaccgacccgggtccccttaccccgtacgaaccctacttacctacctaacgacccgttacccgaaggtccgttaggaacgggaccgtaggacttacggtaactttatttaagttcgaccgtagcccttactaattaacgttacgtagtaaacgttactaaagttcgggtaaacttcccgaagttcggtacgttgggttccgggacgggttacggtaaccctaaggtccgtaacccgtcgttacggtccgttaacggaaccccgg

SEQ ID NO: 387966 - DNA, 545 bp, Homo sapiens
  misc_feature: GZ8MTXP01ACV6V.39.39.D06.1.454.CMB.2.raw
  modified_base (241)..(241): a, c, t, g, unknown or other
  modified_base (250)..(250): a, c, t, g, unknown or other
  modified_base (266)..(266): a, c, t, g, unknown or other
  modified_base (307)..(307): a, c, t, g, unknown or other
  modified_base (446)..(446): a, c, t, g, unknown or other
  modified_base (536)..(536): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactggaaccagcagtgacgttgtntcttatatntgtctcctgttccaangctatcaggcacgcccgacccgtaaattctttaaatttagngtaggtttctttcgcggtcctgtacgggtttctagtcgtctcgtccgtctcagtctaggacaacgccggcctcccgtcacctatctactacgactccgaggctaggagacgaggtctgaacttattatcgacagtctanattactacgtgaatcaagttgtaacttccacgttgggtactcggttacgggcgggttacggtaaccgtaagtcgaccgtcgttacggtcncggaacccg

SEQ ID NO: 387967 - DNA, 546 bp, Homo sapiens
  misc_feature: GZ8MTXP01CM5FL.39.39.D06.1.454.CMB.2.raw
  modified_base (268)..(268): a, c, t, g, unknown or other
  modified_base (451)..(451): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgtccaacngcattcagcagccgaccccgaaactcttaaatttatgtaggttctttcgtcggtccctcgtacggggtttctagtcgtcttctcccgggtctccgaagtcctgggacaaccgacggccctccctgaccctatctctagactccaggctaggacggacgagctagacttattattgcagcctanattatacgtgaaagtcaatggtacttccagttggtctggttccggcgggaagggaacctaaggttcgacccgttcgttaggtcaacggtaacccg

SEQ ID NO: 387968 - DNA, 520 bp, Homo sapiens
  misc_feature: GZ8MTXP01ANCNX.39.39.D06.1.454.CMB.2.raw
  modified_base (227)..(227): a, c, t, g, unknown or other
  modified_base (267)..(267): a, c, t, g, unknown or other
  modified_base (349)..(349): a, c, t, g, unknown or other
  modified_base (444)..(444): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctcgtgtctgagactcctggacagtcgatcaccatctcctgcactggaaccngcagtgacgttggtgcttatatatgtctctggttccaacngcattcaggcagcgcctacgaaacttcttaatttatgtagttctttcgtcggtcccttcgtaggggtttctagtcgtcttcnccggtctccgaagtctcggcaacgacggtccctccctgaccatcctactacgactccgagctggagacgagctggactattatgacagctcagtntactgaagtcaaatggttactcacgtgccttagttcgggacggtaacggactaagtcgaccgttactggcaaccgg

SEQ ID NO: 387969 - DNA, 610 bp, Homo sapiens
  misc_feature: GZ8MTXP01ADXAI.39.39.D06.1.454.CMB.2.raw
  modified_base (228)..(228): a, c, t, g, unknown or other
  modified_base (242)..(242): a, c, t, g, unknown or other
  modified_base (251)..(251): a, c, t, g, unknown or other
  modified_base (264)..(264): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcacatctcctgcactaggaaacngcagtgtacgtgtntattatatntgtctctgtacangctatcgagcacgaccgtaccctaacttactttaattagtcgtacgttcgttcgtcgtcctcggtacggtttctacgtcgtcttccgtaccgtctcgtacgtctacgtacaccgtccgtcccttccctacgtacctacttctacgtacgtacctaccgaggtcgtacgggaacggtacgtaggtcttagtaacgtttagttacgtcgacgtacgtcttactaacttatacgtagtaactacgtaagttcgtaacttccgtacggttcggtccgttcgggttacgggacgggttaacggtaacgttacggtccggtaccgttacgttacggtccgaaccggtaaccg

SEQ ID NO: 387970 - DNA, 571 bp, Homo sapiens
  misc_feature: GZ8MTXP01DZUZR.39.39.D06.1.454.CMB.2.raw
  modified_base (243)..(243): a, c, t, g, unknown or other
  modified_base (274)..(274): a, c, t, g, unknown or other
  modified_base (313)..(313): a, c, t, g, unknown or other
  modified_base (366)..(366): a, c, t, g, unknown or other
  modified_base (459)..(459): a, c, t, g, unknown or other
  modified_base (463)..(463): a, c, t, g, unknown or other
  modified_base (469)..(469): a, c, t, g, unknown or other
  modified_base (486)..(486): a, c, t, g, unknown or other
  modified_base (518)..(518): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcaccatctcctgcactggaaccagcagtgacgttggngtacttaataatatgtactctagttaccaangctaattcaggcagccgaaccccgaaattcttaaatttnagtacggttctttcggccgtcctgtacggggtttctagtcgtcttcgtcccgntccaagtctaggaccaaaccgcggccctcccagaccatctactaagaccttccgaaggctgaaggacgaggactgaacttatttagtcgacanctanattaancgtagaaattcaaagtntaacttcctagttggtacgttcggttacgggngggaacggtaaccgtaaagttccgtaccgtccgttaaggtccaacggaacccg

SEQ ID NO: 387971 - DNA, 660 bp, Homo sapiens
  misc_feature: GZ8MTXP01B5BX0.39.39.D06.1.454.CMB.2.raw
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctgccctgactcagcctgcctcgtgtctggtctctggacagtcgatcacctatctcctgacacgtggaaccagcaggtgtacgttggtaggttataactatgtctcttggtaccaacactccacccaggacaaacgtaccccaaactagatagtaatttagtgtaacgtactaactaaaccggtccctacgtacggggtttactaaccgttcggtcttcgtctcggtcctaccgaacgtctcggaccacgtaccggtccctacccgtacgaccctatccgttcgtcgggccttaccgacgggtccgtaggacgggacgacggtctacgttacttacgtttcttgccgaacgtctacctataactacaagtactatttacacgttaacgtttggggttcggttccgggttacgggtaccgggtacccggttaccgttcggttacccggttaacgttacggtccacgggtcccgttaacggtcccgttccccggtaacccccgg

SEQ ID NO: 387972 - DNA, 542 bp, Homo sapiens
  misc_feature: GZ8MTXP01BS7VC.39.39.D06.1.454.CMB.2.raw
  modified_base (226)..(226): a, c, t, g, unknown or other
  modified_base (268)..(268): a, c, t, g, unknown or other
  modified_base (331)..(331): a, c, t, g, unknown or other
  modified_base (341)..(341): a, c, t, g, unknown or other
  modified_base (443)..(443): a, c, t, g, unknown or other
  modified_base (481)..(481): a, c, t, g, unknown or other
  modified_base (533)..(533): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcacatctctgcacgtgaaccngcagtgacgttggtgtacttataatatgtctcctgtccaaangctatcaggcagccgacccgtaaactctttaattatgtagttctttcgcgtcctgtacggttnagtctcttcnccgctcagtctagcaacgcggtcctccctagacctatctctacgactccgaggctaggacggacgtaggctaggtacttaagttacgttgacctagccttanattaactacagtaatcaagtcgtaattcccgattggtnttcggttcgggccggaggaacctaaggttcgacccggtcttacgggtaaccncggaacccg

SEQ ID NO: 387973 - DNA, 560 bp, Homo sapiens
  misc_feature: GZ8MTXP01C76LG.39.39.D06.1.454.CMB.2.raw
  modified_base (457)..(457): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccatctcctgcactggaaccagcagtgacgttggtgacttaataatatcgtctccgtggttaccaaacagctattcaggcagcccgaccccgaaattcttaatttatgagttcttcgcggccctgtacgggtttcagtcgtcttcgtcccgctccaagtctacggacaacgaccgtcctcccctagaccctatcctactagactccgagctaggaagacgaggactgaacttattagtgactagcttanaataatatagaacgtactaagttcgtacttcgtacgttcgtcgtggttcgggacggaacggtaactaagttccgaccgtacgttacggtaacaaccgtaaccg

SEQ ID NO: 387974 - DNA, 567 bp, Homo sapiens
  misc_feature: GZ8MTXP01EPHYW.39.39.D06.1.454.CMB.2.raw
  modified_base (229)..(229): a, c, t, g, unknown or other
  modified_base (244)..(245): a, c, t, g, unknown or other
  modified_base (253)..(253): a, c, t, g, unknown or other
  modified_base (266)..(266): a, c, t, g, unknown or other
  modified_base (268)..(268): a, c, t, g, unknown or other
  modified_base (272)..(272): a, c, t, g, unknown or other
  modified_base (298)..(298): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtnnttataatntgtctctgtacangnatcngcagccgaccctaaattctttaattntgtagttcttcgcgtcctgtacgggttctagtctcttcgccgctcagtctggaccaacgccggtcctccctagacctactctactacgactacccgagggtcctaggaacggtaccgagtcttagtaactttatttagtcgactacgtctacgtaattactacgtagtaacgtactaagtaacgtacttcctagttcggtcgttgggttcgggacggttacgggaaccttaggtccgtaacccgtcggttacggccgaaccgtaacccg

SEQ ID NO: 387975 - DNA, 616 bp, Homo sapiens
  misc_feature: GZ8MTXP01ECIZM.39.39.D06.1.454.CMB.2.raw
  modified_base (231)..(231): a, c, t, g, unknown or other
  modified_base (244)..(244): a, c, t, g, unknown or other
  modified_base (252)..(252): a, c, t, g, unknown or other
  modified_base (265)..(267): a, c, t, g, unknown or other
  modified_base (292)..(292): a, c, t, g, unknown or other
  modified_base (372)..(372): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagacctcctggacagtcatcacctatcctctgcactggaaccngcagtgacgttgncttatatntgtctctgtcaannntcagcagccacctaaatcttaattngtagttcttcgcgcctgtacggttctagtctcttcgcccgactccgtagtctcgactaccgaccgtctaccctgaacctnttcctactaacgacccttaccggaggtcctagggacggacgtacggtacttacgtactttaagtttacgttcacgtaactccttataacgttaactacgtaaaggtaacttaccgtaaaggttaaccggttaacttcccgtaggttcggtaccggtttcgggttaccggggacggggttaacggtaacccgttaaaggttccggacccggttacgttacggggttaaccaaccgggtaaccccg

SEQ ID NO: 387976 - DNA, 591 bp, Homo sapiens
  misc_feature: GZ8MTXP01AYY0Q.39.39.D06.1.454.CMB.2.raw
  modified_base (188)..(188): a, c, t, g, unknown or other
  modified_base (238)..(238): a, c, t, g, unknown or other
  modified_base (248)..(248): a, c, t, g, unknown or other
  modified_base (260)..(260): a, c, t, g, unknown or other
  modified_base (266)..(266): a, c, t, g, unknown or other
  modified_base (282)..(282): a, c, t, g, unknown or other
  modified_base (289)..(289): a, c, t, g, unknown or other
  modified_base (380)..(380): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctganctcctggacagtcatcacatctcctgcactgaaccagcagtgacgttggntcttataatntgtctctgtcangctatnagcagccacccgaatnttaattntgtagttcttcgtccgcctgtacgggtttctagtcgtcttccgtaccgctccgtaagtcgtacggccaacgccgtccctccctacgacctntcctacgtactacctaccgagggtcctagggacgacgtacggtcttaacggaactttattacgttgaaccgtagtcctactattaactacgtagtaaattacgtaaagttcggttaacttccggtacgttggtcccgttcgggttaccgggttcggaacggtaacccgtaagttaaccgaccggttcgttaacggtccgaacgtaacccgg

SEQ ID NO: 387977 - DNA, 745 bp, Homo sapiens
  misc_feature: GZ8MTXP01D0J02.39.39.D06.1.454.CMB.2.raw
  modified_base (243)..(243): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcaccatctcctgcactggaaccagcagtgacgttggtntacttaataattatgttccttccgtaggttacccaaatgactattcgagggtcacggccctaaccccgtaaaatttctttaaagtttagtggtacggtttcctttccggtcggtaccccgttcggtaacggggtttcctaggtccgtccgtttcccgtacccggtaccttcccgaaagttccgtacgggaacctaaacccggtcccgggtccccttaccccgtacgacccttacgttccgtacttaacgacccttaccggaaggtaactgggaacggaacggagtaccgtacgtaactttaagtttacggtctacgtataccttaacaagtttaaccttaacgtaaggtaaaccgttataaacggtttcggtaaccttccgtaaacccgttgggttaaccgggtttcgggttaccgggacggggttaaccggtaaccggttaaaggtttccggttaaaccccggttccgttaaacgggtccgttaacccgggtaacccccgg

SEQ ID NO: 387978 - DNA, 722 bp, Homo sapiens
  misc_feature: GZ8MTXP01BLTQV.39.39.D06.1.454.CMB.2.raw
  modified_base (255)..(255): a, c, t, g, unknown or other
  modified_base (267)..(267): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgccctccgtgtctgagtacctcctggacagtcgactcacctatcctcctgcacgtcggaaccagctagtgtacgttggtntacttataattntcgtccttccgtggttaccaacagtactagttcgaggtaccacggaccccgtaccccgttaaaactttacttttaaatttacgttacggtaacggtttccgtttccggtacccggtcccgttacggtttaccggggttttcctacggttcccgttcctttcccggtaaccccgggtacttaacccggtaaacgttccgtacgggaccctaaaccgtacccgggtcccttacccgtacgtaaccctacttccgtacgtacgtaccgtacccggaggtcgtaggacggtacgaggtactaggttacttaagtttacgtacggactacgtactactaagttaactaaccgtaggtaaactactaagtcggtacttacccgtagttcggtcgttacgggttcggacgggacggtaacgttacggtcgaccgttcgttacggtccttaaccggtaacccg

SEQ ID NO: 387979 - DNA, 753 bp, Homo sapiens
  misc_feature: GZ8MTXP01C691S.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctccgtgtctgagacctcctggacagtcgatcaccatctcctgcactggaaccagcagtgacgttggtgtacttataatatgtctcgtacggttcaaacagctattcaggcacgcccgaccccgtaaacttactttaaatttagttacgtacggtttcctttccggtccgtcccttcggttacgggtttctagttcgtccttccgtcccgtctcccgagttccgtacgaccaacgtaccggtcccttacccgtcgaaccctacttacctacgtacgtacctaccgacggtcgtacgggaacgggtaccgacgggtaccgttacggtaactttaacgttttacggtttacgacgtaacggtccttacgtaactttaaacttaccgttaggtaaacggttaaccttaaaggtttcgggtaaaccctttccccggtaaggtttacggggtccggttttaacggggttacccgggggttaacccgggggttaaaccggggtaacccggtttaaacgggtttaaccggtaaccccgggttaccggttaacgggttaaccccgaacccggggttaacccccggg

SEQ ID NO: 387980 - DNA, 611 bp, Homo sapiens
  misc_feature: GZ8MTXP01AS368.39.39.D06.1.454.CMB.2.raw
  modified_base (245)..(245): a, c, t, g, unknown or other
  modified_base (268)..(268): a, c, t, g, unknown or other
  modified_base (382)..(382): a, c, t, g, unknown or other
  modified_base (411)..(411): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtntcttatatatgtctctgtaccanagctatcgaggcacgcccgaccccgtaaacttctttaatttagtggtacggtttctttccggtccgtcccgtggtacgggtttctaggtcgtcttccgtccgcctcgacgtcgngaccacgtaccggccctaccctcgacctntcctacgtacgtacctacgaggtctaggacggacgacggtctacgacgtttattattcgctacgtctaacgtattaactacgtagtaagtacgtaagtggttacttaccgtacgttcggtacgttcgggttaccgggcggttaccgggtaacgtaacggttccggtaaccgtccggttacggtcgttaaccgtaacccgg

SEQ ID NO: 387981 - DNA, 686 bp, Homo sapiens
  misc_feature: GZ8MTXP01C038T.39.39.D06.1.454.CMB.2.raw
  modified_base (230)..(230): a, c, t, g, unknown or other
  modified_base (245)..(245): a, c, t, g, unknown or other
  modified_base (274)..(274): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctcctgccactggaaccngcagtgacgttggtntcttataatatgtctcctggttaccaaangcattcaggcacgcccgaccccgtaaaattcttaaatttagtggtacggtttcctttaccggccggtcccttcggtacggggttttcctacggttccgtccgtttcccgtcccgggtccttccgtaaagtccgtacgggaccaaaccgtcccgggtccctccccgtagtaccctattcctacgtacgacctacccgagggtcctagggaacggtacgacgtacgtagtacttaagttacgttcgactacgtccctagtaatttaacgtacgttaggtaaacgttcgtaaagttcggttaacttacccgtacggttcgggttaacggttcgggttaccggggacggggaacgggtaaccccgtaaaggttccggaacccggttcgttaacgggtccgaaccggtaaccccggg

SEQ ID NO: 387982 - DNA, 637 bp, Homo sapiens
  misc_feature: GZ8MTXP01A5LSJ.39.39.D06.1.454.CMB.2.raw
  modified_base (229)..(229): a, c, t, g, unknown or other
  modified_base (265)..(265): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttatatatgtctctgtcangcatcagcagccgacccgaaatcttaattatgtagttctttcgcgtccctgtacgggtttctagtcgtcttctccggctccgtaagtcgtcgggacctaaccgaccgggtcccttaccctcgaaccctaacttcctctaacgtacctaccgaacggtctagggacggacggacggtaccgttaggtaacctttaagtttacgtttacggcctaaggtcccttaacctaaggtttaaactaaccgttaggtaaacgttcaaagttaacgggtaacttcccgaaacgttgggtacgttcgggttcgggcggggttacggtaaccgtaacggttcggtaaacccgtcggttaacggcccgttaacggaaccccgg

SEQ ID NO: 387983 - DNA, 573 bp, Homo sapiens
  misc_feature: GZ8MTXP01CRNIJ.39.39.D06.1.454.CMB.2.raw
  modified_base (424)..(424): a, c, t, g, unknown or other
  modified_base (447)..(447): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttataatatgtctctggttcacagcattcaggcagccgaccccgtaaactcttaaatttatgaggttctttacgtcggtccctcgtacggggtttctagtcgtcttccgtcccggctccaagtctcgggcaacgaccggcctccctgacctatctctacgactcgaggctggagacgnggctgacttattatgactagctntatattacgtagaagtacaagttcggttaacttcccgtaacgttgggtaccttgggtttccggggcggttacggggaacctaaggttcggtaacccggtccgttagggttccaacggtaaccccgg

SEQ ID NO: 387984 - DNA, 646 bp, Homo sapiens
  misc_feature: GZ8MTXP01C9QBG.39.39.D06.1.454.CMB.2.raw
  modified_base (229)..(229): a, c, t, g, unknown or other
  modified_base (244)..(244): a, c, t, g, unknown or other
  modified_base (267)..(267): a, c, t, g, unknown or other
  modified_base (291)..(291): a, c, t, g, unknown or other
  modified_base (298)..(298): a, c, t, g, unknown or other
  modified_base (483)..(483): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctctgcactggaaccngcagtgacgttggtncttatatatgtctctgtaccaangcatcaggcagccgaccctaaatnttaattntgagttctttcgcgcctcgtacgggtttctacgtcgtccttcgtacccggcttccgaagtcctacgggacctaaccgccggtccctcccgtacgaccctagttcctacgtacgtacctccgagggtctgggaacggtaccgaggtccttaccgttacttaagtttacttggacctagacccttanaattaaacctaactaacgtctaattttacgtcgttaacgggtttggggttacggttacggggaaccggggtacgggttaacccgttacccggttcggtaaaccccggtttgtttaaccgggaccgaaccgttacccggtaacgggccccgtttaacccccggg

SEQ ID NO: 387985 - DNA, 633 bp, Homo sapiens
  misc_feature: GZ8MTXP01AX09R.39.39.D06.1.454.CMB.2.raw
  modified_base (229)..(229): a, c, t, g, unknown or other
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttatatatgtctctggttccaanagcattcaggcacgccgaccccgtaaacttctttaatttagtggtacggttcttttaccggtccggtcccttcggtacgggggtttctaggtccgtccgtttccgtcccggccttccgaagtccgtacgggacctaacgacccggtccctaccctacgaccctactcctacgtacgacctaccgaggtccgtacggaacggacgaacggcttaggtaccgtttaatttaagtcggactacgtcttacctatttcgacttaactcgtaggttgtaacgttcgtttattcggttcgttaacgggtaaggttacggacgttaaggtcgtacgttcgttacctaggttcctaacgaacccgaaacccg

SEQ ID NO: 387986 - DNA, 622 bp, Homo sapiens
  misc_feature: GZ8MTXP01CQB0G.39.39.D06.1.454.CMB.2.raw
  modified_base (229)..(229): a, c, t, g, unknown or other
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtacttataatatgtctcctgttaccaangctattcgagcacgccgaccccgtaaatctttaattagtgtacgttcctttcgccggtcctcggtacggggtttctagtcgtcttccgtccggctccgtaagtcgtagggaccaaccgtaccggccctcccgtagacctatcctactaacgccttaccgagggtcctagggaacggacgtaggctagaactttattagttcgactagtcctataattacactagaacgtctaaagttggtaaccttccgtagttcgggttaccgtgggttaccggggacgggttaacgggtaacccttaaagggtttccgaacccggtttacgttaacgggtccgaaccgggtaaccccg

SEQ ID NO: 387987 - DNA, 749 bp, Homo sapiens
  misc_feature: GZ8MTXP01AR86U.39.39.D06.1.454.CMB.2.raw
  modified_base (231)..(231): a, c, t, g, unknown or other
  modified_base (279)..(279): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtggaaccngcagtgtacgttggtgtacttataatatgtcttcctcggttaccaacngactattcgaggaccacggcccgaccccgtaaaacttacttttaaatttagtaggtacggtttccgtttaccggtccggtcccgttcgttaccgggggttttctacggttcgtccgttccgtcccggtctcccgtaacgtccgtacggaccgtaaaccgaccgggtcccctaccccgtacgtaacccttaacttccctaccgtacgtacccgttaccgacgggtacgtacgggaacgggacgacgggtacttacgtaacgtttaacgtttaacgttcggacctaggtaccttaccgtaatttaaacgttacgtaacggtaaacttacgtaaacgttaacgggttaaccttacccgtaacggttcggttaccgttacggggttccggggacggggttaaacggggtaaccgttaaacggggttcccggtaacccggttaccggttaacggtccgaacccgggtaaccccgg

SEQ ID NO: 387988 - DNA, 605 bp, Homo sapiens
  misc_feature: GZ8MTXP01DO7AW.39.39.D06.1.454.CMB.2.raw
  modified_base (201)..(201): a, c, t, g, unknown or other
  modified_base (229)..(229): a, c, t, g, unknown or other
  modified_base (257)..(257): a, c, t, g, unknown or other
  modified_base (274)..(274): a, c, t, g, unknown or other
  modified_base (306)..(306): a, c, t, g, unknown or other
  modified_base (386)..(386): a, c, t, g, unknown or other
  modified_base (390)..(390): a, c, t, g, unknown or other
  modified_base (399)..(399): a, c, t, g, unknown or other
  modified_base (423)..(423): a, c, t, g, unknown or other
  modified_base (461)..(461): a, c, t, g, unknown or other
  modified_base (490)..(490): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctctcactcagggcacgagggtcctgggcccagtctggcctgacacagcctgcctccgtgtctgagactcctggacngtcgatcactatctctgcacgtgaaccngcagtgacgttgatgtacttaataattntgtctcgtagtaccaangtcatcgagcacgccgacctaattcttaattngtagttcttcgcgtcctgtacggttctagtcgtcttacgccgtctacgtaagtccgtagaccaacgtccgtccctcgtanactnctacgtacncgtcgaggtcctaggacgtaacgngtcgttaggtaaacttgttactcggactagtcccttanaaacgttagtaaccgtagtaaaccggttnaaaacgttcgggttacctccgttaggttcgggtacttacggggttccggggacgggtaaccgggtaacttaacgggtttaccggacccggttcgttaacgggccgtaaacccggg

SEQ ID NO: 387989 - DNA, 641 bp, Homo sapiens
  misc_feature: GZ8MTXP01ATSYF.39.39.D06.1.454.CMB.2.raw
  modified_base (237)..(237): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgagtacctccgtggacagtcgatccacctatctcctgacacgtagaaccngacagtgacgttggtgtacttaataatatcgtccttccgtaggttaccaacgagtctattcgacggccacggcccgaaccccgtaaattctttaaagtttacgtaggtacgtttcgtttaccggccgtccctggttacggggtttctacgtccgtcttccgtcccgtctcgagtctacggacctaaccgaccggtccctaccacgacctatcctacgtacacgtcgaggtctgggaacgacgacggtctagtacttagttacgtgacgtagtctagaattaacgtacgtagtaaacgttcgtaaagttcggtaacttaccggttgttcgggtcgttacgggttacgggttcggaaacggttaaccgtagtaaccgtcccgtagaccggtcgaaccgtaacccgg

SEQ ID NO: 387990 - DNA, 750 bp, Homo sapiens
  misc_feature: GZ8MTXP01CGWYP.39.39.D06.1.454.CMB.2.raw
  modified_base (710)..(710): a, c, t, g, unknown or other
  modified_base (728)..(728): a, c, t, g, unknown or other
  modified_base (740)..(740): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgccctcccgtcggcggatagtgaagtggtggtaggttcgggtccgccgacggcccccgaaggggaaggggctggtagttggagttaggtagaaaagtaaagtgggaacgggaccgggggacaaccgaactaacaagtcgccgtcccgtacggacggggtcgagtaccaacctaagttactcgtacgaccgtaacgaaaccgaaacggtacccaaacgtaaacccctacctttccgtaccccgtggaacggtcctacgtaacccccccttcgtacggtacccgaccccgggccccggaaccgggtaacccgtcccgggtaccctaaagtttaactttaacgtttagttcgggtacggtacggttaaggtttaggttttcggacgtagggttacgttcggggtttacgggggtacggttagttaccgggtacgttcggggtacggggtacgaagggtacgtcggtaacgggttcacgttccgtcctccgtcgaccgtcctaccgaccgaccggtcccaacgttccgttccctcccgttgcccncttcgcttccgaaggtcnccgcctcggacncgcgaaccgg

SEQ ID NO: 387991 - DNA, 651 bp, Homo sapiens
  misc_feature: GZ8MTXP01DO1T1.39.39.D06.1.454.CMB.2.raw
  modified_base (621)..(621): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcgagatgaagtggtggagttcgggtccgccacgccccgagggaagggctggagttggattggtagaaataaagtggaggaccgggggcaaccgaactacaagtcgccgtccctacgaggggtcgagtacaccatatctgacagaacaacgtaccaaacgaacccactttcctcccgtagacggctacgacccctcgtgtcgacccgccgaccgactccggacctaagttattacttagttgtcgacgtagtttagttttgacgtaggtattcggttaggggtacgttagtccggacggttcgtaggggtacaaaggggtctacggtaacgggtctaacgttcgtccgtctacgaccgtccctaccgaaccgaccggtccctaacgttcccggttcccttcccccgttggccccgtcccttcggcccttccgaacgggacncccgtacccgtccggagtccgcgaaccggg

SEQ ID NO: 387992 - DNA, 614 bp, Homo sapiens
  misc_feature: GZ8MTXP01A6Y7E.39.39.D06.1.454.CMB.2.raw
  modified_base (230)..(230): a, c, t, g, unknown or other
  modified_base (245)..(245): a, c, t, g, unknown or other
  modified_base (255)..(255): a, c, t, g, unknown or other
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtggaaccngcagtgacgttggtntcttataatntgtctctgttccaangcattcaggcacgcccgaccccgtaaattctttaaatttgtggtacgttctttcgcggtcctggtacggggtttctaggtccgtccgttcgtacccggtacctccgtaaagtcgtacggaccgaaccgtaccgggtcccctacccgtacgacctacttccgtactacgtaccgttacccgaggtctagggacggacgaggtcttagtacttaagttgttcgactaagccttaatagttaactactaggtaactactaaagttcgtaacttcctagttggtacgttggttaccgggcggttacggtaactaacggttcgaccgttcgacgtccgaacgtaacccg

SEQ ID NO: 387993 - DNA, 585 bp, Homo sapiens
  misc_feature: GZ8MTXP01B1JLQ.39.39.D06.1.454.CMB.2.raw
  modified_base (226)..(226): a, c, t, g, unknown or other
  modified_base (240)..(240): a, c, t, g, unknown or other
  modified_base (249)..(249): a, c, t, g, unknown or other
  modified_base (262)..(262): a, c, t, g, unknown or other
  modified_base (294)..(294): a, c, t, g, unknown or other
  modified_base (348)..(348): a, c, t, g, unknown or other
  modified_base (413)..(413): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctctgcagtgaaccngcagtgacgttggntattatatngtctctgtaccangcatcagcagccacccgtaaattcttaatttngtacgttcgttcgcgtcctgtacgggttcagtcgcttcgccgctcgacgttcgnggaccaacgtccggcctcccagtactacgtcactacgaccttccgagtctacgggaggaaccggngtacgttacgttaacgtttagtttacgtcgacgtacgtactacgtaaattacgtaacgtaagtaacgtcgtaagttcgtaacttccgtacggttcggttacggttcgggttaccgggacgggacgtaacgtaacggttcccgtaccggtacgttacgtaaccgccgtaaccg

SEQ ID NO: 387994 - DNA, 620 bp, Homo sapiens
  misc_feature: GZ8MTXP01CNVMV.39.39.D06.1.454.CMB.2.raw
  modified_base (229)..(229): a, c, t, g, unknown or other
  modified_base (244)..(244): a, c, t, g, unknown or other
  modified_base (255)..(255): a, c, t, g, unknown or other
  modified_base (267)..(267): a, c, t, g, unknown or other
  modified_base (357)..(357): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatcctcctgcactggaaccngcagtgacgttggtntcttatatatntctctgtccaangctattcaggcagccgaccccgtaaatcttaatttatgtacgttctttcgtcgcctcgtacgggttctgtcgtctcgtccgctcgagtcngacacgccgcctccctacgaccattctactacgacctccgacggcgttaggacgggtacgacggtacttagtaacgttatttacgttcggactacggtccttacgaaattacgtaacttagaaagttactaaagttgttaaccgttccgtaacggttcggttacgtcgggtttaccggggcgggttaaaccggggtaacccgttaaggtttaaccggaacccggtttacccgttaacgggtaacccgaacgggtaacccccgg

SEQ ID NO: 387995 - DNA, 774 bp, Homo sapiens
  misc_feature: GZ8MTXP01AWA0B.39.39.D06.1.454.CMB.2.raw
  modified_base (273)..(273): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgtacttataatatgtctcgtgtaccaangctattcgagcacgccgaccccgtaaacttctttaatttagtacggttacggttcctttccggtccggtcccttcggttaacgggggttttcctaggttccgtcccgtttaccgtcccgggtaccttaacccgtaaagttccgtacgggaaccctaaaccggtccccgggtaccccttccccgtacgtaaccctacgttacccgttaccgtaaccgtaccgttaccccgtaagggtccgtagggaacgggtaaccggtaacgggtacgtttacggaaactttaacgttttaacggttcgaacccgttacggtaccttaaccgttaaattaaacgttacgttaaacggtaaaacgttaccgttaaaagtttccggggttaaacttaccccggtaaacggttcgggtaacggtttcggggttacccgggggcgggttaaacgggtaaccctagggttaacccggtacccgtaccggttacggttaaccgaacggtaaccccgg

SEQ ID NO: 387996 - DNA, 646 bp, Homo sapiens
  misc_feature: GZ8MTXP01BQK8O.39.39.D06.1.454.CMB.2.raw
  modified_base (228)..(228): a, c, t, g, unknown or other
  modified_base (240)..(240): a, c, t, g, unknown or other
  modified_base (242)..(242): a, c, t, g, unknown or other
  modified_base (249)..(249): a, c, t, g, unknown or other
  modified_base (262)..(262): a, c, t, g, unknown or other
  modified_base (264)..(264): a, c, t, g, unknown or other
  modified_base (302)..(302): a, c, t, g, unknown or other
tcagtcgcactagtcacgaccggtgctcgatttagtgacatctcgcatttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctctgcacgtgaaccngcagtgagttgntnttatatntgtctctgtacangntatcgaggcacgccgtaccccgtaaacttctttaattntgtacgttctttcgtccgccttacggttcgggtttctagtcgtccttcgtaacccgtctccgaagttcacgggaccaaccgtccggtccctcccgtacgaccctacgttcctaccgttacgacccgtaccggtaggtcgacgggacgggaccgtcgggtactacggtaacgtttactttaagtcgcgtacgtccttacttatttacgacctaagtacgttggtagaacggtttactttgttacggtttaccggttaaacgggtaacgggttaccgggttaccgttaaggttccgtacgtttccggttacgtacggttaccgaacccgttaacccgaaaccccgg

SEQ ID NO: 387997 - DNA, 737 bp, Homo sapiens
  misc_feature: GZ8MTXP01ECBUI.39.39.D06.1.454.CMB.2.raw
  modified_base (641)..(641): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatggaagtgggtggaggttcgggtccgccgacgcccccgaggggaaggggctggaggttggagttaggtagaaataaagtggaacggaccgggggacaaccgaactaacaagtcgccgtcccgtacgaggggtcgacgtccaccgtatatcgtgacagaacaagtaccaaagtaaccctacttcctaccctagacggtctcgtacccctcgtcggtcgacccgccgaaccggactccggacctaattaattactttagttggtacgtacgtagtttaggtttttgacgtaggtacgttcgggttagggggtcgttagtaccggtaggttcgggtacggggtaacgaacgggtacgtacggtaacggttcctaacgttccgtccctccgttacgaccgtcccgtaccgaacccgtaaccgggcccctaacggttccccggttccccttcccccggngggtcccccgtccccgttcggttccccgttacccggaacggtacccgtaacccgtaaccccggtccggaacggtaacccgaaccgtaaccccgggg

SEQ ID NO: 387998 - DNA, 599 bp, Homo sapiens
  misc_feature: GZ8MTXP01D8PFR.39.39.D06.1.454.CMB.2.raw
  modified_base (208)..(208): a, c, t, g, unknown or other
  modified_base (214)..(214): a, c, t, g, unknown or other
  modified_base (224)..(224): a, c, t, g, unknown or other
  modified_base (238)..(238): a, c, t, g, unknown or other
  modified_base (248)..(248): a, c, t, g, unknown or other
  modified_base (263)..(264): a, c, t, g, unknown or other
  modified_base (267)..(267): a, c, t, g, unknown or other
  modified_base (295)..(295): a, c, t, g, unknown or other
  modified_base (507)..(507): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctctcactcaggcacagggtcctgggcccagtctggcctgacacagcctgcctccgtgtctgagactctggacagtcatcaccntctctncactacgacngcagtgacgttggntcttataatntgtctcgtgtacaannatntcagcacgccacccgtaattcttaattntgacgtttcttcgccgtctcgtacggtttcagtctctcgtccgatcgtaagtctagacaaaccgtccggtaccctcctacgacctacgtctactacgacctaccggacgtacgtaggaacggacgacgggtactacgtaacgtttattacgttcgactagtcctactaattaacgtacgtagtaaacgttcaaagttaacgtacttaccccnggttcggtacgttccggttacgggccggaacggttaaaccggtagttaaccggtacccggttacgttacgtaacccggaacgttaaccccgg

SEQ ID NO: 387999 - DNA, 677 bp, Homo sapiens
  misc_feature: GZ8MTXP01ANEEG.39.39.D06.1.454.CMB.2.raw
  modified_base (230)..(230): a, c, t, g, unknown or other
  modified_base (254)..(254): a, c, t, g, unknown or other
  modified_base (269)..(269): a, c, t, g, unknown or other
  modified_base (564)..(564): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatctcctgcactggaaccngcagtgacgttggtgcttataatntgtctctgtaccaangcatcagcacgccgaccccgtaaattcttaatttatggtacgttctttccggcgtccctcgtacggggtttctagtcgtcttcgtacccggctccgaagttcctcgggacctaaaccgacccgggtcccttaccccgtagtaaccctattccgtaccgtacgaccttcccgaagggtccgttagggaacgggaccgtacgggtcttaacggacctttaagtttacgttcggacgtacgtccttacgtaacttaacgttaaccgtagtaaacggttactaaagttcgggttaaacncccggttaacgttcgggtaccggttagggttcccggggacggttacggggtaaaccctaagggtttcccgaacccgggttcgttaaacgggtcgttaacccgggtaaccccgg

SEQ ID NO: 388000 - DNA, 623 bp, Homo sapiens
  misc_feature: GZ8MTXP01DGJYO.39.39.D06.1.454.CMB.2.raw
  modified_base (226)..(226): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccatctctgcactgaaccngcagtgacgttggtgtcttaataatatgtcttcctggttaccaacagcattcaggcacgccgaccccgtaaattcttaaatttatgacggtttctttaccggtcgtccctggtaccggggtttctacgtcgtccttccgtcccggtctccgaagtccgtagggaccaaaccgccgtaccctccctacgtacctactctcgtaacgacccgtacgtacgggtcgtacggaacgggacgtaggtacgtacgtaactttaatttacgttacgtacgactacttactaagttaacctagtaagtaagtactaagtaaggttacaccgtacgttggtacggttggttcgggttcggagggtaacgtaagtcggtaccgacgttacgtcgttaacgaacccgg

SEQ ID NO: 388001 - DNA, 720 bp, Homo sapiens
  misc_feature: GZ8MTXP01EDN9Z.39.39.D06.1.454.CMB.2.raw
tcagtcgcactagtcacgaccggtgctcgatttagtgacatctcgcagttctttgggggggggtctcaggaggcagcgctctcaggacatctccaccatggcctgggctctgctgctcctccaccctcctcactcagggcacgagggtcctgggcccagtctggcctgacacagcctcgccctccgtgtctgagtacctccgtggacagtcgatcatcatcctctgcacgtaggaaccagcagtggtacggttggtgtactttaataattactcgttccttccgttacggttaacccaaacgtgtacctaaatttccggaaacggtcccaaccggaccccgtaacccccgtaaaattttaccttttaaattttagtcggtacgtttccgtttccggtcccggtcccgttacggttacggggtttctacggtcctccctttcccgacccgtctaccgtaacggttccgtacggaccctaacgtcccggtcccctcccgtacgtaccctacttcctaccgtaactacccgtccgagggtctacggaacggccgtaagtcttaacgggtaactttagttactcgggacctagcccttataaatttacgtacgtaaggtaacgtcgtaaagttcggttaacctcgttacgtgggtcgttggggttccggacgggtaacggtaacgtaaggttacgacccggttgtaaccgggttaacgaaccgg

SEQ ID NO: 388002 - DNA, 693 bp, Homo sapiens
  misc_feature: GZ8MTXP01BCGZ1.39.39.D06.1.454.CMB.2.raw
  modified_base (212)..(212): a, c, t, g, unknown or other
  modified_base (232)..(232): a, c, t, g, unknown or other
  modified_base (247)..(247): a, c, t, g, unknown or other
  modified_base (257)..(257): a, c, t, g, unknown or other
  modified_base (276)..(276): a, c, t, g, unknown or other
  modified_base (285)..(285): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccntccgtcctgcactggaaccngcagtgacgttggtnacttataatntgtcctcgttgtaccaacngtcagttcncggtaccacgcccgtacccgtaaacttctttaattagtgtacggttctttcgtaccggtcccttagttacggggtttcagtccgtcttacgcccgtctcgtaacgtccgtgggacccaaacgtcccggtccctaccctcgacccttatccgtacgtacgtacccgttacgacggtcgtacggacgggaacgtcgggtacttacgtaccgggttaatttacgtcgtaccgtaacggtctacctaagttaactacgttaaaccggtagttaaccgtaagttaacggttaaaccttacggtacggttttgggacccggttgggttacccggggcgggttaaacgggtaaccccgttaaaggttcccgggtaaaccggttcccggttaggttaacccgaacggaaccccggg

SEQ ID NO: 388003 - DNA, 685 bp, Homo sapiens
  misc_feature: GZ8MTXP01A2HMW.39.39.D06.1.454.CMB.2.raw
  modified_base (245)..(245): a, c, t, g, unknown or other
  modified_base (276)..(276): a, c, t, g, unknown or other
  modified_base (293)..(293): a, c, t, g, unknown or other
  modified_base (505)..(505): a, c, t, g, unknown or other
  modified_base (526)..(526): a, c, t, g, unknown or other
  modified_base (544)..(544): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacgagggtcctgggcccagtctggcctgacacagcctcgccctccgtgtctgacgtacctccgtggacagtcgatccacctatctcctgaccacgtacggaacccngacgagtggacggttggtatacttaataatntgtcctcgtgtaccaanagctatcgaagcacgcccgaaccctaaattcttaaattcgtaggttaccggttcctttaccggtccggtcccgtttacggttacggggtttcctacggttcccgtcctttccccgtaccgggtacccttaacccgtaagggtcctaaccgggaccccaaccggtccccgtccccttacccgacgaccttacgtcctacgtaccgactaccgngggtacgtcggaacgggaacnggtaccttagtaactttnttacgtcgactacgccttaagaacgttatagtacggaattacgtaagtcgttcttacggtcggttgttcggtcggttaccgggggagttaccgggtaactacggttccgtacggtaccgttacgtccgaaccggtaacccg

SEQ ID NO: 388004 - DNA, 565 bp, Homo sapiens
  misc_feature: GZ8MTXP01DJYK1.39.39.D06.1.454.CMB.2.raw
  modified_base (245)..(245): a, c, t, g, unknown or other
  modified_base (273)..(273): a, c, t, g, unknown or other
  modified_base (306)..(306): a, c, t, g, unknown or other
  modified_base (338)..(338): a, c, t, g, unknown or other
  modified_base (409)..(409): a, c, t, g, unknown or other
  modified_base (503)..(503): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactcggaaccagcagtgacgttggtncttaataatatgtctctggttaccaaangcattcaggcagccgaccccgtaatcttaattntagtgttcttcgcgcctgtacggttctagtcncttccgtcgctcaagtctagacacacggtcctccagacctactacgtactacgactcgagctggacgacgngactagaacttatttatcgacaagcctactataactacgtagtaaagtcaaagttcggtaacttcccgaacgttcggtcgttggttaccggggngggaaccggtaacgtaaaggttccgacccggttccgttaacggtccgaaccggtaaccccgg

SEQ ID NO: 388005 - DNA, 577 bp, Homo sapiens
  misc_feature: GZ8MTXP01E0K2I.39.39.D06.1.454.CMB.2.raw
  modified_base (231)..(231): a, c, t, g, unknown or other
  modified_base (272)..(272): a, c, t, g, unknown or other
  modified_base (442)..(442): a, c, t, g, unknown or other
  modified_base (488)..(488): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatccaccatctcctgcactggaaccngcagtgacgttgtgcttataatatgtctcctggttccaacngcattcaggcagccgccccgaaacttcttaaatttatggtacggttctttcgtccggccctcgtacgggggtttctagtcgtcttcctcccggctcccaaagtctgggacacgaccgggccctccctacgaccattcctactacgactcccgaggtcctagacgggacgnggtacgtgaacttatttaattgacagtctactataatactagtaancctaagtggtacttccgtagttggtcgttggttacgggcggacgggtaactaacggttcgaaccgtccgttagggtcaacgtaaccccg

SEQ ID NO: 388006 - DNA, 600 bp, Homo sapiens
  misc_feature: GZ8MTXP01E1626.39.39.D06.1.454.CMB.2.raw
  modified_base (228)..(228): a, c, t, g, unknown or other
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccngcagtgacgttggtgacttataatatgtcctctgttaccaangctattcaggcagccgaccccgaaattcttaatttgtgtacggttctttcgccgccgtgtacgggtttcagtcgtcttccgtccggtctcgaagtctaggaccaacgacgcctccctgaccatcgtctacgctaccgaggtctggacgacgaggtctagtacgttattagtcgacctagctacattactacgtagaaagtcaaagttcggtaacttccgaacgtttcgggacgtttcggggttacccggggcgggaaccgggtaaccgtaagggtttaacccggtaccccggttaacggttaccgggttcccgaaccggtaacccccggg

SEQ ID NO: 388007 - DNA, 576 bp, Homo sapiens
  misc_feature: GZ8MTXP01DREQ4.39.39.D06.1.454.CMB.2.raw
  modified_base (189)..(189): a, c, t, g, unknown or other
  modified_base (230)..(230): a, c, t, g, unknown or other
  modified_base (245)..(245): a, c, t, g, unknown or other
  modified_base (254)..(254): a, c, t, g, unknown or other
  modified_base (256)..(256): a, c, t, g, unknown or other
  modified_base (269)..(269): a, c, t, g, unknown or other
  modified_base (302)..(302): a, c, t, g, unknown or other
  modified_base (354)..(354): a, c, t, g, unknown or other
  modified_base (449)..(449): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctctcactcagggcacagggtcctgggcccagtctggcctgacacagcctgcctccgtgtctganactcctggacagtcgatcaccatcctcctgcactggaaccngcagtgacgttggtnattataatntntctctgtaccaangcatcagcagccgaccctaaattcttaatttangagtttcttcgtcgcctcgtaggttctagtcgtcttcgtccgctccaagtcncggacaacgcggtccctccctacgacctatctactacgaacctccgaggctagggacggacgaggtctagaacgtttatttacgtgacagtcctntaattaacttacgtaagaacgttcaaaggttcgtacttaccgagttggctttagggttcggggttcccgaaggggtaactaaccggttttggaccccgtacggttaacgtccggaaccgtaaccccg

SEQ ID NO: 388008 - DNA, 627 bp, Homo sapiens
  misc_feature: GZ8MTXP01EZVBD.39.39.D06.1.454.CMB.2.raw
  modified_base (259)..(259): a, c, t, g, unknown or other
  modified_base (279)..(279): a, c, t, g, unknown or other
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatccaccatctcctgccactaggaaccagcagtgacgttggtgtacttaataatntgtcctcgtcggtaccaaangcattcgaggcacgccaccccgtaaattctttaaatttagtcgtacggtttcctttcggtccggtccttcggtacggggtttctagtcgtcttccgtccgtctctaagtctcgactacgtaccgcctccctagacctatctactacgacctaccgaggtcgtaggacggacgacggtctagtactttagtttagtggactgtcctactaagtactacgtgtaaacgtacgtaagtcggtaacttcccgtaaggttcggtaacgtttcgggttacggggaccgggttaacgggtaacctaagggtttccggtacccggttcggttacgggtccgaaccggtaaccccgg

SEQ ID NO: 388009 - DNA, 569 bp, Homo sapiens
  misc_feature: GZ8MTXP01EGPEW.39.39.D06.1.454.CMB.2.raw
  modified_base (226)..(226): a, c, t, g, unknown or other
  modified_base (240)..(240): a, c, t, g, unknown or other
  modified_base (265)..(265): a, c, t, g, unknown or other
  modified_base (338)..(338): a, c, t, g, unknown or other
tcagtcgcactagtcacgaccggtgctcgatttagtgacatctcgcagttctttgggggggtctcaggaggcagcgctctcaggacatctccaccatggcctggctctgctgctcctcaccctcctcactcagggcacagggtcctgggcccagtctggcctgacacagcctgcctccgtgtctgagacctctggacagtcgatcaccatctctgcactggaaccngcagtgacgttggncttataatatgtctctggttccaangcattcaggcaggcaccccgaaatcttaatttatgaggtctttacgcggcctgtacgggtttcagtcgcttcncccggcttcccgaagttctgggacctaaacgccgggtccttaccctcgaccactctactagactcagctgaggacgaggctacgacgtattattgtacagtctctatatactagtaagtaccaagtaaggtacttactaaccgttggtcgttggttacgggttcgaacgggggggggtaacctaaacggttcgtacccggttccgttacggttaacgaacggtaaccccgg

SEQ ID NO: 388010 - DNA, 791 bp, Homo sapiens
  misc_feature: GZ8MTXP01BUFTZ.39.39.D06.1.454.CMB.2.raw
  modified_base (229)..(229): a, c, t, g, unknown or other
  modified_base (273)..(273): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataatatgtctccgtaggttccaacngctattcaggcagccgaccccgtaaacttctttaaatttatggtaggtttcctttcggtccggtcccttcggtacgggggttttcctaggttccgtctttccgtcccgggccttccgaaagttctacgggacctaaaaccgcccggggtaccccttccccgtacgtaaccctacgtttaccctacgttaccgaaccctttcccggaacggggtaccttacgggggaaccgggttaaaccgggaacggggttaccttaacgggtaaaccgttttaaacgttttaacggttttacggacccgtaacgggttacccgttaccgtaaatttaaacgtttaaacccgtaggtaaaacgttaccgttaaaaggttaacggggtttaaacttccccgttaaacgggttcggtaccggttttcggggtttacccgggggcgggttaaacccgggggtaaaccttaacggggtttccggtaccccgggttaccggttacgggttaaccgaacccgggtaaccccggg

SEQ ID NO: 388011 - DNA, 518 bp, Homo sapiens
  misc_feature: GZ8MTXP02GQSSE.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaaactcttaatttatgagttctttcgtcggccctcgacggggtttctagtcgctttctccggctccaagtctggcaacacggcctccctgaccatctctagacctccaggctgagacgaggctgactattattgcagctcatatactgaagtcaaagtggtactccagtggcttgttccgggcggtagggaaccgtaaggttcgaccgttcgtacggtcacgacccg

SEQ ID NO: 388012 - DNA, 569 bp, Homo sapiens
  misc_feature: GZ8MTXP02HG0WZ.39.39.D06.1.454.CMB.2.raw
  modified_base (213)..(213): a, c, t, g, unknown or other
  modified_base (225)..(225): a, c, t, g, unknown or other
  modified_base (239)..(239): a, c, t, g, unknown or other
tcagtcgcactagtcacgaccggtgctcgatttagtgacatctcgcagttctttgggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcngcactggaaccngcagtgacgttggncttataattatgtctcctggttccaacagcattcaggcagccgccccgaaatcttaatttatgagtctgtcgtcgcctcgtagggtttctagtcgtcttccgtccgctaccaagtctgaccaacgacggccctccctgacctactcctactacgactccgaggtctaggacgacgaggtctagacttattattcgactagctacaattatacgtagaaacgttacaaaagttcggtaactaccctacgtacggtccgttacggttccgggacggtaacgggaaccctaaagggtttccgaaacccggtttccgtaagggttaccaaccgg

SEQ ID NO: 388013 - DNA, 492 bp, Homo sapiens
  misc_feature: GZ8MTXP02F1MGN.39.39.D06.1.454.CMB.2.raw
  modified_base (465)..(465): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaaactcttaatttatgtaggttctttcgtcggtccctcgacggggtttctagtcgcttctccggctccaagtctggcaacacggcctccctgaccatctctagactccaggctgaggacgagctgactattattgcagctcatatactgaagtcaatggtatcactgctgtcgngaggcagttcgacgtctaggtcagccg

SEQ ID NO: 388014 - DNA, 500 bp, Homo sapiens
  misc_feature: GZ8MTXP02IIWK9.39.39.D06.1.454.CMB.2.raw
  modified_base (360)..(360): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctggtaccaacaatatccaggcacacgcccccaaactcatcatttatgaggtcagtaatccggcctcgtaggggtttctatcgcttctctgctcagtctgcacncgcctcctgaccatctctgggctccgagctgagacgaggctagatttatactgcagctctatttgactaatcgagtcgaggctttagtcgtacttcggaaagttggaaccaaggtcagttcgtacctaggtcacgacccg

SEQ ID NO: 388015 - DNA, 512 bp, Homo sapiens
  misc_feature: GZ8MTXP02FSF42.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaaatcttaatttatgaggttctttcgtcggccctcgacggggtttctagtcgcttctccggctccaagtctagcaacacggcctccctgaccatctctagactccaggctgagacgagctgactattattgcagctcatatactgaaagtcaaatggtactccacgtggcttcgttcggcggagggaacctaagttcgaccgtctaacggtcacgacccg

SEQ ID NO: 388016 - DNA, 507 bp, Homo sapiens
  misc_feature: GZ8MTXP02J1GFF.39.39.D06.1.454.CMB.2.raw
  modified_base (228)..(228): a, c, t, g, unknown or other
  modified_base (347)..(347): a, c, t, g, unknown or other
  modified_base (379)..(379): a, c, t, g, unknown or other
  modified_base (434)..(434): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgaccccgaaactcttaatttatgtagtctttcgtcggcctgtacggggtttctagtcgcttcnccggctccaagtctggcaacgcggtcctcccngacccatcctactagactccgaggctgacggacgaggctgactattatgcagctnatatactgaatcaatggatccatggctgtcggcggtaggaaccgtaagttcgaccgtcgacggtcacgacccg

SEQ ID NO: 388017 - DNA, 535 bp, Homo sapiens
  misc_feature: GZ8MTXP02I9F7A.39.39.D06.1.454.CMB.2.raw
  modified_base (227)..(227): a, c, t, g, unknown or other
  modified_base (304)..(304): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgaccccgaaatcttaatttangtagtctttcgtcgccctcgtacggggtttctagtcgtcttcgtccgctccaagtctggcaacacgcctcctcgaccatctctagacctcacggctagaggacgaggctaggacttattattcgacagctcaattactactagaaagtcaaaagtcggtaactccaacgtggcttcggttaccggacggaaggtaacctaaggttacgaccgtcgtaacggtcacgacccg

SEQ ID NO: 388018 - DNA, 505 bp, Homo sapiens
  misc_feature: GZ8MTXP02IYT8L.39.39.D06.1.454.CMB.2.raw
  modified_base (465)..(465): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagccgaccccgaaatcttaatttatgagttctttcgcgtcctcgtaggggtttctagtcgctttcgccggctccgaagtctggacaacacggcctccctgacctatctcagactcagctgagacgagctagactattatgctagctcatatactgaagtcaattggtactcactggctgttcggnggacggaacgtagttcgaccgtcgtacggtacacgacccg

SEQ ID NO: 388019 - DNA, 529 bp, Homo sapiens
  misc_feature: GZ8MTXP02F6TZV.39.39.D06.1.454.CMB.2.raw
  modified_base (228)..(228): a, c, t, g, unknown or other
  modified_base (436)..(436): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgcccccgaaaatcttaaatttatgaggttctttcgtcggcccctcaggggttttctagtcgcttctccggctccaagtctggccaacacggcctccctgacccatctctagactccaggctgaggacgaggctgacttatattgcagcctanatatactagaagtcaagtcgtactcctacgtggtcgttcggtacggacggaacggaaccgtaaggttcgaccgtcgtacggtaccacgacccg

SEQ ID NO: 388020 - DNA, 527 bp, Homo sapiens
  misc_feature: GZ8MTXP02FZ52F.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgacccccgaaaactcttaaatttatgaggttctttcgtcggccctcgtacggggtttctagtcgcttctccggctccaagtctggcaacgacgcctccctgaccatctctagctccaggctgagacgaggctagactattattgcagctcatatactgaagtcaattggtactccacgtggctcgttacggcggtaaggggaaccctaaggttcgtacccggtcctaaggtccaacgacccg

SEQ ID NO: 388021 - DNA, 494 bp, Homo sapiens
  misc_feature: GZ8MTXP02FTLYD.39.39.D06.1.454.CMB.2.raw
  modified_base (463)..(463): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagaatcctggacagtcgatcaccatctcctgcactggaaccagcagtgacgttggtgcttataattatgtctcctggttccaacagcattcaggcagcgccccgaaatcttaaatttatgaggttctttcgtcgcccctgacggggtttctagtcgtcttctccggctccaagtctggcaacacggcctccctgacccatctctagactccaggctgagacgaggctgactattattgcagctcatatactgaagtcaatggtatccatgctgtcgnggaggccaagtcgaccgtctaggcagacccg

SEQ ID NO: 388022 - DNA, 492 bp, Homo sapiens
  misc_feature: GZ8MTXP02JGPI1.39.39.D06.1.454.CMB.2.raw
  modified_base (228)..(228): a, c, t, g, unknown or other
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggccccagtctggcctgacacagcctgcctccgtgtctgagactcctggacagtcgatcaccatctcctgcactggaaccngcagtgacgttggtgcttataattatgtctcctggttccaacagcattcaggcagcgccccgaaaactcttaaatttatgaggttctttcgtcggccctcacggggtttctagtcgcttctccggctccaagtctggcaacacggcctccctgacccatctctagactcccaggctgagacgaggctgactattattgcagctcatatactgaatcaatggtatcactgctgtcgcgaggccagttcgacgtcaggtcagaccg

SEQ ID NO: 388023 - DNA, 518 bp, Homo sapiens
  misc_feature: GZ8MTXP02JIFBM.39.39.D06.1.454.CMB.2.raw
  modified_base (352)..(352): a, c, t, g, unknown or other
  modified_base (391)..(391): a, c, t, g, unknown or other
  modified_base (433)..(433): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaaacagcattcaggcagcgaccccgaaaactcttaaatttatgaggttctttcgtcggccctcacggggttttctagtcgcttcnccggctccaagtctggcaacacggcctccctgaccatcnctagactccaggctgagacgaggctgactattatgcagctanatatactagtaagtacaagtcgtactctacgtggtcgtcggtcggacggacggaacgtagttcgaccgtcgtacggtcacgaccg

SEQ ID NO: 388024 - DNA, 511 bp, Homo sapiens
  misc_feature: GZ8MTXP02GNVUE.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcatttcaggcagcgaccccgaaaactcttaatttatgtaggttctttcgtcgtccctcgtacggggtttctagtcgcttcgtccggctcctaagtctggccaacacggcctccctgaccatctctagactccagctgagacgagctgactattatgcagctcatatactagaagtcaatgtactcacgtgctcgtcggcggtaggaaccgtaagttcgaccgtctaggtcacgacccg

SEQ ID NO: 388025 - DNA, 520 bp, Homo sapiens
  misc_feature: GZ8MTXP02G4OMP.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgagttctttcgtcgccctcgtacggggtttctagtcgcttcgtccggctccaagtctggcctaacacggcctccctgaccactctctagacctcagctgagacgagctgactattatgcagctcatattacaagacagtaatactgtccgtttcggcggacgggtacaacgtcttacgaaccgtcgtacggtcacgacccgaacggctcccg

SEQ ID NO: 388026 - DNA, 508 bp, Homo sapiens
  misc_feature: GZ8MTXP02HRMAO.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaaactcttaatttatgagttctttcgtcgccctcaggggtttctagtcgcttctcccggctccaagtctggcaacacggcctccctgaccatctctagcttccagctgaggacaggctgactattatgcagcttcatatacagaagttcaaattggtaatccactggcttggttcgacggaggaaccgaagttcgaccgtcgtacggtcacgacccg

SEQ ID NO: 388027 - DNA, 495 bp, Homo sapiens
  misc_feature: GZ8MTXP02G6L8O.39.39.D06.1.454.CMB.2.raw
  modified_base (243)..(243): a, c, t, g, unknown or other
  modified_base (324)..(324): a, c, t, g, unknown or other
  modified_base (419)..(419): a, c, t, g, unknown or other
  modified_base (429)..(429): a, c, t, g, unknown or other
  modified_base (434)..(434): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcatagggtcctgggcccagtctggcctgacacagcctgcctccgtgtctgagactcctggacagtcgatcaccatctcctgcactggaaccagcagtgacgttggngcttatattatgtctctggttccaacagcattcaggcagcgccccgaaatcttaatttatgaggttctttcgtcggccctnacggggtttctagtcgcttctccggctccaagtctggcaacacgcctccctgaccatctctagactcaggctgagacgagctgactattatgcantcatatatanagtanaatagtatcactgcgtgttcgcggaggaaccgagtacgtacgtcgtacgtacgacgacccg

SEQ ID NO: 388028 - DNA, 526 bp, Homo sapiens
  misc_feature: GZ8MTXP02IPPL4.39.39.D06.1.454.CMB.2.raw
  modified_base (272)..(272): a, c, t, g, unknown or other
  modified_base (376)..(376): a, c, t, g, unknown or other
  modified_base (386)..(386): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaaacngcattcaggcagccgacccccgaaaatcttaaatttatgtaggttctttcgtcgccctctacggggtttctagtcgtcttctccggctccaagtctggcaaacncggcctcccngaccatctctagacctcagctgacggacgaggctagacttatttatgacagtctacatatactagaagtcaaatcggtaatcaacgtgcttcgttcggcggtaggaaccgaagttcgaccgtactacggtacacgacccg

SEQ ID NO: 388029 - DNA, 523 bp, Homo sapiens
  misc_feature: GZ8MTXP02HSM3M.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgttccaacagcattcaggcagcgccccgaaactcttaatttatgtaggttctttcgtcggcctcgtacggggtttctagtcgtctttctccggctccaagtctggccaacacggccttccctgaccatctctagactccaggtctgaggacgaggctgacttatttactgtcagctacatatactagaacgtctaagtcggtaactccacgtggtctggtcggcggaggaacgtaagttcgaccgtcgtacggtcacgacccg

SEQ ID NO: 388030 - DNA, 519 bp, Homo sapiens
  misc_feature: GZ8MTXP02IHDKR.39.39.D06.1.454.CMB.2.raw
  modified_base (379)..(379): a, c, t, g, unknown or other
  modified_base (435)..(435): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctcctggttccaacagctattcaggcagccgaccccgaaatcttaatttatgtagttctttcgtccgcctcgtacggggtttctagtcgtcttcgtccggctccagtctgcaacgcgcctcccngaccatctctagacctccgaggctagacggacgagctgactatttatgacagctanatatactagagtacaaatcggtactccgatcggcttggttacggcggaggaaccgtaagttcgaccgtcgtacggcacgacccg

SEQ ID NO: 388031 - DNA, 534 bp, Homo sapiens
  misc_feature: GZ8MTXP02H14BE.39.39.D06.1.454.CMB.2.raw
  modified_base (440)..(440): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaaactcttaaatttatgtaggttctttcgtcggccctctaggggtttctagtcgcttctccggctccaagtctggcaacacggcctccctcgaccatctctagactcagctgagacgaggctgacttagttattgcagctacattanactagaaagtctaaaagtggtactcctacgtggacttcggttacggcggtaagggaaccgaaggttcgaccgttccgtaacggttcaacgcccg

SEQ ID NO: 388032 - DNA, 530 bp, Homo sapiens
  misc_feature: GZ8MTXP02HTOFW.39.39.D06.1.454.CMB.2.raw
  modified_base (217)..(217): a, c, t, g, unknown or other
  modified_base (270)..(271): a, c, t, g, unknown or other
  modified_base (350)..(350): a, c, t, g, unknown or other
  modified_base (354)..(354): a, c, t, g, unknown or other
  modified_base (367)..(367): a, c, t, g, unknown or other
  modified_base (370)..(370): a, c, t, g, unknown or other
  modified_base (377)..(377): a, c, t, g, unknown or other
  modified_base (409)..(409): a, c, t, g, unknown or other
  modified_base (417)..(417): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacctatttccngcactggaaccagcagtgacgttggtgtcttataattatgtctctgtaccaannctatcagcacgccgacccctaaatcttaattatgtagttctttcgccgtcctgtaggtttcctagtctcttctcgctcngtcngcacgcgcctctnacntctctanctcgagctagagacgagctagtacttattatncagtctanattatactagaatacaagttacgtactccgtagtcggtacgttcggtacgggacggtaacggtaacgtaaggttcgaacccgttcgtaacggtaccaacggtacccgtaacgg

SEQ ID NO: 388033 - DNA, 500 bp, Homo sapiens
  misc_feature: GZ8MTXP02HZGKO.39.39.D06.1.454.CMB.2.raw
  modified_base (255)..(255): a, c, t, g, unknown or other
  modified_base (320)..(320): a, c, t, g, unknown or other
  modified_base (346)..(346): a, c, t, g, unknown or other
  modified_base (355)..(355): a, c, t, g, unknown or other
  modified_base (361)..(361): a, c, t, g, unknown or other
  modified_base (369)..(369): a, c, t, g, unknown or other
  modified_base (376)..(376): a, c, t, g, unknown or other
  modified_base (411)..(411): a, c, t, g, unknown or other
  modified_base (414)..(414): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcacatctcctgcactggaaccagcagtgacgtgtgctataatatgtctccngttcaacagcatcaggcagcgaccccgaaaactcttaaatttatgtaggtctttcgtcgcccctnacggggtttctagtcgcttctccggntccaagtcngcaacncgcctccnaccatcnctagactccagcagagacgagctgatattatgcantanatatatatagtataatagtactactacgtacgtcgtcgtcggtacggacggaacgtaacgtacgtacgtacgtacgtacgacgacg

SEQ ID NO: 388034 - DNA, 532 bp, Homo sapiens
  misc_feature: GZ8MTXP02JQA99.39.39.D06.1.454.CMB.2.raw
  modified_base (386)..(386): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaactcttaatttatgtagttctttcgtcggtccctgtacggggtttctagtcgtcttcgtccggctccaagtctggacaacgacggccctcccngacccatctctagacctccaggcctggacggacgaggctgacttattattgacagctacatatactagaagtcaaattcggtactccacgtggcttcggttcggcggagggaacctaggttcgaccgtcgtacggtcacgtacccg

SEQ ID NO: 388035 - DNA, 553 bp, Homo sapiens
  misc_feature: GZ8MTXP02IHN5P.39.39.D06.1.454.CMB.2.raw
  modified_base (259)..(259): a, c, t, g, unknown or other
  modified_base (324)..(324): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatgggtggagttgggtccgccagcccccagggaaggggctgagttggattggtgaaataatgagacggggnacaatacaatgcgtcctcagggtcagtcaccatatctgcagacaagtaccaaagaaccacttacnccctgagctgacccctctgtgaccgcgcggactcggccatatattatgtgcgagtagttttgacaggtatcgttggggcgttaatcgacgtcgtggggtcaaaggggactcgaggtcagttcgtctccttcacgcctaccaccgaacggggcccctaagtccggtccttcccccgtggcccgcccttagcctaccgaaggggaccaccgaccgtaccgacgacacgacg

SEQ ID NO: 388036 - DNA, 539 bp, Homo sapiens
  misc_feature: GZ8MTXP02HT6SV.39.39.D06.1.454.CMB.2.raw
  modified_base (304)..(304): a, c, t, g, unknown or other
  modified_base (371)..(371): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaacagcagtgacgttggtgcttataattatgtctcctggttccaacagcattcaggcagccgccccgaaaatcttaatttangtaggtctttcgtcgcccttcgaggggtttctacgtcgtctttctccggctccaagtctggcaaacncggcctccctgaccatctctagactccaggtcctggagacgaggctgaacttatttatgactagctacaattatactagaacgtcaaaagttggtaacttccgaacttgggcttcggtccggacggaggaaccgtaagttcgaccgtacctacgggtactacgacccg

SEQ ID NO: 388037 - DNA, 528 bp, Homo sapiens
  misc_feature: GZ8MTXP02J3A17.39.39.D06.1.454.CMB.2.raw
  modified_base (426)..(426): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgtaggttctttcgtccggcccctctacggggtttctagtcgctttctccggctccaagtctggcaacacggcctccctgacccatctctagactccgaggctgaggacgagctgactnttattgcagctcatatactgaagtcaaatcggtaatccactcggcttcggttcggcggagggaaccctaaggttcgaccggtacctacggtacacggacccg

SEQ ID NO: 388038 - DNA, 717 bp, Homo sapiens
  misc_feature: GZ8MTXP02I2GW6.39.39.D06.1.454.CMB.2.raw
  modified_base (272)..(272): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtcctggcctgacacagcctgcctccgtgtctgagactcctggacagtcgatcaccatctcctgcactggaaccagcagtgacgttggtgtcttatattatgtctcctggttccaacngcattcaggcagccgccccgaaactcttaaatttatgtaggttctttcgtccggcccttcgtacggggtttctacgttcgtcctttcgtcccggtcttccgtaagttccgttgggacctaaccgaccgggtccccttccccgttacgaccctaacttcccttaccttaacggtacccttcccgtaacgggtccttacgggaacgggtacccggaaggggtccttacgggttaaaccctttaagttttaacgtttcgggaccttaacggtcccttaccgtaagtttaacgttaaaccgttacggtaaaagttacctaaaagtttcgggttaaacttccccgtaaacgttcggtacgttcgggtttaccggggcgggtaacgggtaaccgttaaaacggtttccggaacccggttccgttaaacgggttccgaaccggtaaccccgg

SEQ ID NO: 388039 - DNA, 517 bp, Homo sapiens
  misc_feature: GZ8MTXP02JVBQX.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcatttcaggcagcgccccgaaactcttaatttatgtaggtctttcgtcggccctcgacggggtttctagtcgtcttctccggctccaagtctggcaacacggcctccctgaccatctctagactcagctgagacgagctgactattattgcagctacatatactgaagtcaatggtatccactggctcggttcggacggtacgggaaccaaggttcgacccgtcgtacggtccacggtaccccg

SEQ ID NO: 388040 - DNA, 545 bp, Homo sapiens
  misc_feature: GZ8MTXP02GCZPQ.39.39.D06.1.454.CMB.2.raw
  modified_base (415)..(415): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagctaccccgaaatcttaatttatgagttctttcgtcgcccttcgtaggggtttctagtcgcttctccggctccaagtctggcaacgacggccctccctgaccctatcctctaagacctccagtctagagacgngctgactattatgctagctcatatactagaaacgtcaaagttggttactacctacgtggcgttcggttccgggacggagggtaaccgtaaaggtttcggaacccgttccgtaaggtccacggaaccccgg

SEQ ID NO: 388041 - DNA, 557 bp, Homo sapiens
  misc_feature: GZ8MTXP02HLSRQ.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaactcttaatttatgagttcttcgtcggtccctgtacggggtttctagtcgtcttctccggctccaagtctggcaacacggcctccctcgacctactctactgacctccaggctggacggacgagctaggtacttatttattgcagctacatactactgtaagtcaagtcggtaactcaacgttcggtcttcggttcgggacgggacgggtaaccgtaaaggttcgtacccggttaccgtacgggttaccgacgtaaccccgg

SEQ ID NO: 388042 - DNA, 572 bp, Homo sapiens
  misc_feature: GZ8MTXP02HAO0F.39.39.D06.1.454.CMB.2.raw
  modified_base (476)..(476): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttaccaacagcattcaggcagccgaccccgaaaactcttaaatttatgtaggttatttccgtcggtccctgtaggggtttctagtcgtctttcgtccggtctccgaagtctacggaccaacgacggccctccctcgaccatctactacgacctccaggctaggaaggacgaggctagaacttatttatgactagctacatatactagaaactnaaagttggtaactcccaacgtggtcttcggttaccggcgggaaggaacccgtaaaggtttcgaaacccggttccgtaaggtcccgaacgaccccgg

SEQ ID NO: 388043 - DNA, 518 bp, Homo sapiens
  misc_feature: GZ8MTXP02HSJF8.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgacccccgaaaatcttaaatttatgtagtctttcgtcgccctcgtacggggtttctagtcgtcttctcccggctccaagtctggccaacgacggcctccctgaccatctctagacctcaggctgacgacgaggctagacttatttatgcagtctacatatactgaaagtcaatggtactccactggctgttcggcggaggaaccgtaagtcgaccgtctaggctacgacccg

SEQ ID NO: 388044 - DNA, 503 bp, Homo sapiens
  misc_feature: GZ8MTXP02F4654.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcatttcaggcagcgccccgaaaactcttaaatttatgaggtctttcgtcgccctcgacggggtttctagtcgcttctccggctccaagtctggcaacacggcctccctgaccatctctagactccaggctgagacgagctgactattattgcagctcatatactgaaagtcaaatgtactccactggctgttcggcggaggaacgagtcgaccgtctacggtcacgacccg

SEQ ID NO: 388045 - DNA, 544 bp, Homo sapiens
  misc_feature: GZ8MTXP02IITBC.39.39.D06.1.454.CMB.2.raw
  modified_base (437)..(437): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgtaggttctttcgtccggccctcgtaggggtttctagtcgtcttcgtccggctccaagtctggaccacgcgcctccctgaccatctctagactcaggctgaggacgagctagactattatgcagtctanatatactagaacgtctaagttcggtactacccagttacggcttcggttaccgggcggaacggggtaacctaaggttaccgaccgtaccgtacggtccacggaccccg

SEQ ID NO: 388046 - DNA, 511 bp, Homo sapiens
  misc_feature: GZ8MTXP02GKXV7.39.39.D06.1.454.CMB.2.raw
  modified_base (473)..(473): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaactcttaatttatgaggttctttcgtcggccctcgtacggggtttctagtcgctttctccggctccaagtctggcaacacggcctccctgaccctatctctagacctccaggctggagacgaggctgactattattgcagctcatatactgaagtcaaatggtactcacgtgctgtcggnggaggaacctaagttcgaccgtcctaggtcacgacccg

SEQ ID NO: 388047 - DNA, 639 bp, Homo sapiens
  misc_feature: GZ8MTXP02GM08Q.39.39.D06.1.454.CMB.2.raw
  modified_base (227)..(227): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctcctggttaccaacagcattcaggcagccgaccccgaaattcttaaatttatgtaggttctttcgtccgccctgtacggggtttctagtcgtcttctccgttctccaagtctcggaccaaaccgccggtcccttccctacgaccctacttctctaacgaccctccgaggcttaggacgggacgaggtctagtaacttagtttattgacgtagtcctacattaactacgtagtaagtactaaaagttcggtaactacccgtaacgttcgggtaccgtttcggggttaccggggaccggggtaacggggtaaaccccgtaaaagggttttcccggtaaccccggtttacccgtaaacggggttcccgtaaaccggtaacccccgg

SEQ ID NO: 388048 - DNA, 556 bp, Homo sapiens
  misc_feature: GZ8MTXP02ITBJW.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgacccccgaaatcttaatttatgtagttctttcgtcggcctcgtcggggtttctagtcgtcttctcccggtctcctaagtctcggcaaaccgcggccctccctgaccactctactacgaccttccgaggctagaggacgaggctagtactagtttatgcagctactatatacgtagaacgtcaagttggtactcctacgtggtacgttggtccggtacggacgggaaccgtaggttaccggaccgtacgtacggtaccgacggtacccgg

SEQ ID NO: 388049 - DNA, 516 bp, Homo sapiens
  misc_feature: GZ8MTXP02JHA9Q.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaaatcttaatttatgagtctttcgtcgcctcacggggtttctagtcgcttctccggctccaagtctggcaacacggcctccctgaccatctctagactccaggctgaggacgaggctgactattattgcagctcattatactgaagtcaaaattcggtaatccacgttggcttggttcggcggtaagggaacctaaggttcgaccgtccgtaggtccacgacccg

SEQ ID NO: 388050 - DNA, 539 bp, Homo sapiens
  misc_feature: GZ8MTXP02GIHH7.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgtaggttctttcgtcgtccctcgtacggggtttctagtcgtctttcgtccggctcctaagtctggaccaaccgacggtccctccctacgacctactcctctacgacctccgaggctggacggacgaggctgacttattattgcagctcatatactgaagtacaagtcggtactccacgtggcttcggtcggcggtaggaaccgtaagttcgaccgtcgtaggtcacgacccg

SEQ ID NO: 388051 - DNA, 543 bp, Homo sapiens
  misc_feature: GZ8MTXP02HLG38.39.39.D06.1.454.CMB.2.raw
  modified_base (228)..(228): a, c, t, g, unknown or other
  modified_base (383)..(383): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaaactcttaatttatgtagttctttcgtcgtcctcgtacggggtttctagtcgtcttctccggctccaagtctggcaacacggcctcccngaccatctctagacctccgagctgaggacgaggctagacttattagtgcagtctacatatactagaagtcaagttcggtactccgacgtggcttacgggttccggacgggtaacgggtaaccgtaacggttcgacccgtacgtacggtacacggaccccg

SEQ ID NO: 388052 - DNA, 615 bp, Homo sapiens
  misc_feature: GZ8MTXP02G3EP5.39.39.D06.1.454.CMB.2.raw
  modified_base (229)..(229): a, c, t, g, unknown or other
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacngctattcaggcagccgaccccgaaactcttaaatttatgtaggttctttcgtccggtcctcgtacggggtttctagtcgtcttcgtccgctccgaagtctggacaacgacggtcctccctgaccctatctactagacctcgaggctaggacggacgaggctagtacttattagtgacagtctactatatacgtagaaacgtactaaagttcggtaactaccgtaacgttcgggtaccttcggggttaccggggaccggggtaaacggggtaaacccgttaaacgggtttaccggaaaccccgggtttacccgttaacgggtacccgaaccggtaacccccggg

SEQ ID NO: 388053 - DNA, 634 bp, Homo sapiens
  misc_feature: GZ8MTXP02JM30Q.39.39.D06.1.454.CMB.2.raw
  modified_base (223)..(223): a, c, t, g, unknown or other
  modified_base (243)..(243): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctctcactcagggcacagggtcctgggcccagtctggcctgacacagcctgcctcgtgtctgagactctggacagtcgatcacatctctgcactggaaccngcagtgacgttggtgcttanaattatgtctcctggttccaacagcatttcaggtcagcgccccgaaatcttaattatgagttcttcgcgcctgacggggtttcagtcgacttcgtccggcttccgaaagttctagggaccaacgtccgggcctacccgttaggaccctaagttccgtacgtacgtacccgtaccgtacgggtaccttacgggaacggtaccgtaagggttcctacggttaaccgttaatttacgttacggtaccgtaacgtacgtaccgtaagttaacgtacgtagtaaacgttacgtaagttacggtaactcctaaacgtcgggtacttacgggttacggacggtacgggtaaccgtaacggtttcgaccggtacgttacggtaccacggttaaccccgg

SEQ ID NO: 388054 - DNA, 562 bp, Homo sapiens
  misc_feature: GZ8MTXP02II8QD.39.39.D06.1.454.CMB.2.raw
  modified_base (228)..(228): a, c, t, g, unknown or other
  modified_base (243)..(243): a, c, t, g, unknown or other
  modified_base (255)..(255): a, c, t, g, unknown or other
  modified_base (267)..(268): a, c, t, g, unknown or other
  modified_base (370)..(370): a, c, t, g, unknown or other
  modified_base (381)..(381): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctggacccagtctggcctgacacagcctgcctccgtgtctgagactcctggacagtcgatccaccatctctgcactggaaccngcagtgtacgttgtntattatattatntctctgtaccannctatcagcacgacccgaccctaattacttaattagtgtacgttcttcgccgtacctcgtacggtttctgtcgtcttcgtccgtctcgagtctacgaccaccncgtcctcctanaccactcgtactacgtacctcgcgcgtacgacgacgacgacgtacgtacttattagttgtactacgtactactatatactagtaacgtacgtaacgtacgtactactacgtacgtacgttcggtacggtacggtacggtaacgtaacgttacggtaccgtaccgtacgtacgtacgtaccg

SEQ ID NO: 388055 - DNA, 496 bp, Homo sapiens
  misc_feature: GZ8MTXP02GJCK9.39.39.D06.1.454.CMB.2.raw
  modified_base (461)..(461): a, c, t, g, unknown or other
tcagtcgcactagtcacgaccggtgctcgatttagtgacatctcgcagttctttgggggggtctcaggaggcagcgctctcaggacatctccaccatggcctggggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaaactcttaatttatgaggtctttcgtcgccctcacggggtttctagtcgcttctccggctccaagtctggcaacacggcctccctgaccatctctagctcagctgagacgaggctgactattattgcagctcatatactgaagtcaatggtatccactgctgttcggnggaggaacgaagtgacgtctacggtcacgtacccg

SEQ ID NO: 388056 - DNA, 728 bp, Homo sapiens
  misc_feature: GZ8MTXP02I396Y.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgttccaacagcattcaggcacgccgaccccgaaaacttcttaaatttatgtacggttccttttcgtccggccccttcgtaacggggttttcctagtccgtcctttcccgtccgggccttcccgaaagttccgtacgggaccctaaaccgccggtcccttcccgtacgaccctatctacctacgacccttaccgagggtctacggacgggacgacggtaccttacggtaaacctttaattttaacgttgaaccccgtaaggtacccttactaaagttaaactttaaccgtaggtaaaaggttacctaaaagtttcgggtaaaacttccccgtaaacggttacgggttacccgtttaggggtttcccgggggaacggggttaaaccgggggaaaccctttaaaaggggtttcccggtaaaccccgggtttacccggttaacggggttacccgtaaaacggtacccccggg

SEQ ID NO: 388057 - DNA, 504 bp, Homo sapiens
  misc_feature: GZ8MTXP02G321V.39.39.D06.1.454.CMB.2.raw
  modified_base (228)..(228): a, c, t, g, unknown or other
  modified_base (323)..(323): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgaccccgaaatcttaatttatgagtctttcgtcgccctnaggggtttctagtcgcttctccggctccaagtctcggcaacacggcctccctgaccatctctagacctccaggctgagacgaggctgacttattattgacagctacatatactgaagtcaatggtatccactggctgtcggcggtaggaacctaagttcgaccgtctaaggtcacgacccg

SEQ ID NO: 388058 - DNA, 549 bp, Homo sapiens
  misc_feature: GZ8MTXP02JUT19.39.39.D06.1.454.CMB.2.raw
  modified_base (354)..(354): a, c, t, g, unknown or other
  modified_base (375)..(375): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtcttcctggttccaacagcattcaggcagccgaccccgaaaactcttaaatttatgtaggttctttcgtcgtccctcacggggtttctagtcgcttcnccggctccaagtctggcaacncggcctccctgaccatctactagacctccagggctcgaggaccgaggcctgacttattagttgacagccttaacattactacgtagtaagtacaagttcgtactcctacgtcggtcttcggtcggacggaggtaaccgtaggttacgtaccgttacgtacggtaccgacgaccg

SEQ ID NO: 388059 - DNA, 516 bp, Homo sapiens
  misc_feature: GZ8MTXP02F1AE6.39.39.D06.1.454.CMB.2.raw
  modified_base (229)..(229): a, c, t, g, unknown or other
  modified_base (286)..(286): a, c, t, g, unknown or other
tcagtcgcactagtcacgaccggtgctcgatttagtgacatctcgcagttcttttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcnccccgaaaactcttaatttatgaggttctttcgtcgccctcaggggtttctagtcgtcttctccggctccaagtctggcaacacggcctccctgaccatctctagactccaggctgaggacgagctgacttattattgcagctcatatactgaaagtcaaatggtaatccaacgtggctgttcgggcggtagggaacctaaagttcgacccgttctaggtccacgacccg

SEQ ID NO: 388060 - DNA, 519 bp, Homo sapiens
  misc_feature: GZ8MTXP02F4DN2.39.39.D06.1.454.CMB.2.raw
  modified_base (448)..(448): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaacagcattcaggcagcgaccccgaaaactcttaatttatgaggttctttcgtcggtccctcgtacggggttttctagtcgtcttctccggtctccaagtctggaccaacgacggccctccctgacccatctactagactccaggctgaggacgacggctagaacttattattgcagtcctnatatactgaagtacaatcgtatccatgctggtcgcggagaaccgaagtcgaccgtccgtagtcacgacccg

SEQ ID NO: 388061 - DNA, 528 bp, Homo sapiens
  misc_feature: GZ8MTXP02GDIAY.39.39.D06.1.454.CMB.2.raw
  modified_base (422)..(422): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagcgacccccgaaaacttcttaaatttatgtaggttctttcgtcggtccctcgtacggggtttctagtcgtcttcgtccggctccaagtctggaccaacgacggccctccctgaccctatctctagactcagctgagacgnggctgactattatgacagctcaatatactgaaagtcaatcggtactcacgtggctcgtacgggcggaacggaactaaggttcgacccgtcgtacgtcacgaacccg

SEQ ID NO: 388062 - DNA, 507 bp, Homo sapiens
  misc_feature: GZ8MTXP02HA19M.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaacagcattcaggcagcgaccccaaactcttaatttatgagttctttcgtcgcctcaggggtttctagtcgcttctccggctccaagtctggcaacgacgcctccctgaccatctctagacctcaggctagaggacgagctgactatttatgactagctcatactactagaagtcaatcggtaatccactggctgtcggcggaggtaaccgaagttcgacctcgtagtcacgtacccg

SEQ ID NO: 388063 - DNA, 553 bp, Homo sapiens
  misc_feature: GZ8MTXP02IL8IC.39.39.D06.1.454.CMB.2.raw
  modified_base (430)..(430): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctgttaccaacagccattcaggcagccgaccccgtaaatcttaaatttatgtaggttctttccgtccggtccctcgtacggggtttctagtcgtcttcgtccggctccgaagtctggccaaccgcggcctaccctgaccatctctagacctcgaggtctgaacggacgngctgtaactattatgcagctcaattatactgtaagtcaaaagttcggtactcccgaacgttggcgttcggttacggacggaacgggtaactaaggttcgacccgtcgtacggtccacgacccg

SEQ ID NO: 388064 - DNA, 509 bp, Homo sapiens
  misc_feature: GZ8MTXP02FVW81.39.39.D06.1.454.CMB.2.raw
tcagtcgcactagtcacgaccggtgctcgatttagtgacatctcgcagttcttttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcatttcaggcagcgccccgaaaactcttaaatttatgaggttctttcgtcggccctcaggggtttctagtcgcttctccggctccaagtctggcaacacggcctccctgaccatctctagactccaggtctgaggacgaggctgactattattgcagctcatatactgaagtcaaatggtaatccactggctcgttcggcggtaggaaccgaagtgaccgtcctaggtcagacccg

SEQ ID NO: 388065 - DNA, 536 bp, Homo sapiens
  misc_feature: GZ8MTXP02FWXL2.39.39.D06.1.454.CMB.2.raw
  modified_base (228)..(228): a, c, t, g, unknown or other
  modified_base (455)..(455): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctctgtccaacagcatcagcagccgaccccgaaactcttaatttatgtaggttcctttcgtccggtccctcgtacggggtttctacgtcgtcttcctccggctccaagtctggaccaacgacggccctccctgaccctatcctactacgacctccgacggctggacgggacgacggctagacttattattgacagcctnatatactgaagtcaaatcggtaactccagtggtctggttcggacggaggaaccgtaagttcgacgtccgtagcacgacccg

SEQ ID NO: 388066 - DNA, 570 bp, Homo sapiens
  misc_feature: GZ8MTXP02H0CGV.39.39.D06.1.454.CMB.2.raw
  modified_base (246)..(246): a, c, t, g, unknown or other
  modified_base (256)..(256): a, c, t, g, unknown or other
  modified_base (325)..(325): a, c, t, g, unknown or other
  modified_base (377)..(377): a, c, t, g, unknown or other
  modified_base (456)..(456): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaagggctgagttggattggtgaataangagacggggnacaactacaatgcgtcctcgaggggtcgagtcaccatatctgacagaacaagtccaaagaaccacttcnccctgagctgacccctctgtcgaccgcgcggactcggccatatattatttgngcgagtagttttgctaggatcgtttagggggcgttatcggacgtcgtgggggtacaaggggattcgaaggtcagtccgnttcccgtacacgcctccgaaccgtaacggggcccctaagtcccggttccttccccccgtggcccgtcccctcgccctacccgaaggacgccaacccgtccgacgacgccaacgg

SEQ ID NO: 388067 - DNA, 561 bp, Homo sapiens
  misc_feature: GZ8MTXP02ISCMC.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctggttccaacagcattcaggcagccgaccccgaaaatcttaaatttatgtagttctttcgtcgccctgtacggggtttctagtcgtctttcgtcccggtctcccgaaagtctggaccaaacgacggccctccctgaccacttctctagacctcccaggtctgaggacgaggctagacttatttagttgccagctacataatacgtagaaagttcaaattcggtactttcccaagtgggtccttggttaccgggcgggaaggaaccgtaaggttcgacccgtacgtacggtcacgaaccccg

SEQ ID NO: 388068 - DNA, 584 bp, Homo sapiens
  misc_feature: GZ8MTXP02JN2F2.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaaatttatggtaggttctttcgtccggtccctcgtacggggtttctagtcgtcttcgtccggctccaagtctcggcaacgacggtccctcccgtgaccctagtcctacgtacgtaccctccacggctacgggacggaccgaggctaggtaacttatttagttgcctagcctacatatacgtagtaacgtacaattacggtactccgaacgtggtcttcgggttccggcgggtaacgggtaaccgtaaggttcggacccgttacgtacggtaccacggtaccccg

SEQ ID NO: 388069 - DNA, 537 bp, Homo sapiens
  misc_feature: GZ8MTXP02J0OP2.39.39.D06.1.454.CMB.2.raw
  modified_base (229)..(229): a, c, t, g, unknown or other
  modified_base (352)..(352): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaaactcttaaatttatgaggtctttcgtcgccctgtacggggtttctagtcgtcttcnccggctccagtctggcaacacggcctccctgacccatctctagcctccaggctgaggtacgaggctgactattattgcagctcaatatactagtaagtacaaagttcggtactccaacgtcggcttcggttacggcgggtaagggaaccctaaaggtcgtacccgtcgtacggtccaacgacccg

SEQ ID NO: 388070 - DNA, 569 bp, Homo sapiens
  misc_feature: GZ8MTXP02JTOZB.39.39.D06.1.454.CMB.2.raw
  modified_base (228)..(228): a, c, t, g, unknown or other
  modified_base (242)..(242): a, c, t, g, unknown or other
  modified_base (250)..(250): a, c, t, g, unknown or other
  modified_base (252)..(252): a, c, t, g, unknown or other
  modified_base (263)..(264): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtntctatatntntctctgtacanncatcagcacgcgaccgaactcttaattatgtacgttcttcgtccgtctcgtcggttctgtcgtcttcgtccgctcgtacgtcgtcgacacgcgtcctccctacgacctactctactacgactcgacggtctacggacggacgacggtacgtagtacttagttacgtcgcgtagtctatactactacgtagtaacgtacgtaacgttacgtactaccgtacgtacgtacggttcggtaccgggtacgggtaacgggtaaccgtaacggttaccggtaccggtacgtacggtaccgtacggtacccg

SEQ ID NO: 388071 - DNA, 556 bp, Homo sapiens
  misc_feature: GZ8MTXP02JTSBZ.39.39.D06.1.454.CMB.2.raw
  modified_base (351)..(351): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaaactcttaaatttatgaggttctttcgtcggccctgaggggtttctagtcgcttcnccggctccaagtctggacaacgcggcctccctgaccctatctactacgacctccgaggcctaggacgggaccgaggctgacttatttagttgctagctacattatactagaagtacaaagtcggtaactccacgtggtcgttggttaccgggcggaacgggaaccgtaaaggtttcgaacccgttcgtacggtccaacggacccg

SEQ ID NO: 388072 - DNA, 551 bp, Homo sapiens
  misc_feature: GZ8MTXP02IRPWH.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcaggtgacgttggtgcttataattatgtctcctggttaccaacagcattcaggcagccgccccgaaaactcttaaatttatgagttctttcgtccggtcctcgtaggggtttctagtcgtcttctccggtctccaagtctcggcaacgacgcctccctgacctatcctactagacctccacggctggacggacgaggcttagacttatttattgacagtctcaattataactagtaaagtcaaattcggtaactccactacggtcttcggttcggacggacggtaacccgaaagtttcgaccgtctacggtcaacgacccg

SEQ ID NO: 388073 - DNA, 531 bp, Homo sapiens
  misc_feature: GZ8MTXP02JLPPR.39.39.D06.1.454.CMB.2.raw
  modified_base (371)..(371): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaactcttaatttatgtagttctttcgtcggccctcgacggggtttctagtcgcttctccggctccaagtctggcaacncggcctccctgaccatctctacgactccaggctgaggacgaggctgactattatgcagctcattatactagaagtcaagtcggtactcccagtcggcttcggttccggcggaacgggaaccgtaaggttcgaccggttccgtacggttccacggaccccg

SEQ ID NO: 388074 - DNA, 558 bp, Homo sapiens
  misc_feature: GZ8MTXP02GSG7G.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctgtccaangcatcagcagccgaccccgaaattctttaatttatggtagttctttcgtccgcccttgtaccggggtttctagttctcttacgtccggtctcctaagtctggaccaacgaccggtcctccctagacctactctacgtagccttaccgaggtctaggaacggacgaggtctagtaacttattagttgacagtcttacaatataactagtaagtactaagtcgtaactcacgtggcgttacggtcggcggtacggaacgtaaggttcgaccgtcgacggtacacgacccg

SEQ ID NO: 388075 - DNA, 556 bp, Homo sapiens
  misc_feature: GZ8MTXP02IUMAQ.39.39.D06.1.454.CMB.2.raw
  modified_base (379)..(379): a, c, t, g, unknown or other
  modified_base (440)..(440): a, c, t, g, unknown or other
  modified_base (507)..(507): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagccccagggaagggctgagttggattggtgaaataatgagaccggggcaccaactacaatgcgtccctgaggggtcgagtcaccatatctgcagacaagtccaaagaacccacttctccctgacggctgacccctctgtcgaccgccgcgactcggccatatattattgngcgagtagttttgcaggtattcgttgggggcgtatcggacgtcgtggggtacaaaggggtntcgaggtcagtccgtctctcacgcctccaaccgacggccctagtccggtcccttcccccgtggcccncccgtacgcctccgaaggccgacctacccgtccgaacgacgaccaaccg

SEQ ID NO: 388076 - DNA, 561 bp, Homo sapiens
  misc_feature: GZ8MTXP02FWQKC.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctgttaccaacagcattcaggcagccgaccccgaaactcttaatttatgaggttctttcgtcggccctcgtacggggtttctagtcgtcttctccggctccgaagtctggaccaacgacggccctccctgaccatctactagactcaggctgagacgaggctgactattattgcagctacatatactagaaagtacaaagttggtactccgtaacgtcggtacgttcggttacgggaccgggtaacgggtaacccgtaaaggttcgtaaacccggttccgtaacggtccgaacgtaaccccg

SEQ ID NO: 388077 - DNA, 508 bp, Homo sapiens
  misc_feature: GZ8MTXP02FOF3K.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcgccatctcctgcactggaaccagcagtgacgttggtgcttataattatgtctcctggttccaacagcattcaggcagcgccccgaaaactcttaaatttatgaggttctttcgtcggcccctcacggggtttctagtcgcttctccggctccaagtctggcaacacggcctccctgacccatctctagactccaggctgagacgaggctgactattattgcagctcatatactgaagtcaaatcggtatccactggcttgttcggcggaggaaccaagttcgaccgtctaggtcacgacccg

SEQ ID NO: 388078 - DNA, 532 bp, Homo sapiens
  misc_feature: GZ8MTXP02I0ZYA.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcatttcaggcagccgaccccgaaactcttaatttatgagttctttcgtcgcctctacggggtttctagtcgtcttctccggctccgaagtctgccaacacggcctccctgaccatctctagactccacggctggagacgagctgactattattgcagtctcatataactgtaaagtctaagtaggtactaccacgttcggcttcggttacggacggacgggaaccgtaaggttcgaccgtcgtacggtcacggtacccg

SEQ ID NO: 388079 - DNA, 542 bp, Homo sapiens
  misc_feature: GZ8MTXP02JW65W.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaaactcttaaatttactgtagttctttcgtcggcccctgtacggggtttctagtcgtcttcgccggctccaagtctggccaacgaccggccctcccgtcgaccctatcctctacgacctccaggctaggacggacgaggctgaacttattattgacagctacatatactagaagtcaagtcggtatccgacgtggcttcggtcggacggagggaacctaaggttcgaccgttcgtacggtcacgacccg

SEQ ID NO: 388080 - DNA, 717 bp, Homo sapiens
  misc_feature: GZ8MTXP02JM8P9.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttccaanagctattcaggcagccgaccccgaaattcttaatttatgtagttctttcgtccgccctgtacggggtttctagtcgtccttcgtcccggtctcccgtaaagttccgtcgggaccaaaccgccgggtcccccttccccgtacgtaaccctacttccctaccgtaacgtacccgttacccaacgggccgttacggaacgggtaccggaacgggtccgttacggtaaacctttaagtttaacgtttcggaccgtaaacggtcctttaacaaacgtttaataaccgtttaaggtaaacgtttaacgaaaacgtttcgggttaaactacccgtaacgttacgggttccgtttcgggttaccgggggtaccggggtaaaacggggtaacccgttaaacgggttaccgggtaacccggttaccggttaaccggttaccgaacggtaacccccgg

SEQ ID NO: 388081 - DNA, 527 bp, Homo sapiens
  misc_feature: GZ8MTXP02F4IUN.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcatcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaaatttatgtagttctttcgtcggtcctcgtaggggtttctagtcgtcttcgtccggtctcaagtctggcaacgcggcctccctgacccatctctagactccagctgacgacgaggctagacttattattgcagctacatatactagaagtctaaagtggtactccgaactggtcttcggttcggacggaaggaccaaggtttcgaccgtaccgtacggtcaaccgg

SEQ ID NO: 388082 - DNA, 529 bp, Homo sapiens
  misc_feature: GZ8MTXP02I5NX2.39.39.D06.1.454.CMB.2.raw
  modified_base (265)..(265): a, c, t, g, unknown or other
  modified_base (268)..(268): a, c, t, g, unknown or other
  modified_base (294)..(294): a, c, t, g, unknown or other
  modified_base (421)..(421): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctctgtccangcntcagcagcgcccgaatcttaatttangagttctttcgcgcctgacgggtttctagtctcttctccggctccagtctggccaacacggccctccctgaccctatcctctacgactccgaggctgagacgaggctgactattatcgctagcctanatatactagaacgtacaagttacggtatcccgagtggtcttggttccggacggtaggggtaaccgtaaaggttcggaacccgttccgtacggtacgaccgtaacccgg

SEQ ID NO: 388083 - DNA, 495 bp, Homo sapiens
  misc_feature: GZ8MTXP02IUUZ5.39.39.D06.1.454.CMB.2.raw
tcagtcgcactagtcacgaccggtgctcgatttagtgacatctcgcagttctttgggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctcctggttccaacaacattcaggcagcgccccgaaactcttaatttatgagtctttcgtcgccctcaggggtttcctagtcgcttctccggctccagtctggcaacacggctcctgaccatctctagactccagcctgaggacgaggctgactagttattgcagctcatatactgaagtcaaatggtactccatggctgttcggcggaggaccaagttcgaaccgtctagtcagcccaagg

SEQ ID NO: 388084 - DNA, 582 bp, Homo sapiens
  misc_feature: GZ8MTXP02GVVMG.39.39.D06.1.454.CMB.2.raw
  modified_base (243)..(243): a, c, t, g, unknown or other
  modified_base (500)..(500): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtntcttataattatgtctcctggttaccaacagctatcaggcacgccgaccccgtaaacttctttaatttagtggtacggttctttcgtccggtcccttgtacggggtttcaggttcgtctttctcccggctccgtaagtctcggacctaaccgacggccctccctgaccctatctactacgacctccgacggtctaggagggaccgaggtacctagtaacttatttagtcgacagtcctataataactatagaactanaattacggtactacgtacgtcggtcttacggtcggacggtaggaaccgtaaggttccgacgtacgtacggtacaacgacccg

SEQ ID NO: 388085 - DNA, 526 bp, Homo sapiens
  misc_feature: GZ8MTXP02F668N.39.39.D06.1.454.CMB.2.raw
  modified_base (228)..(228): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctctgttccaacagcattcaggcagccgaccccgaaactcttaatttatgtagttctttcgcgccctcgtacggggtttctagtcgtcttcgtccggctccgaagtctggccaacgacggccctccctgacctatctactacgactccaggctgacggacgagctagactattatgactagctcatatactgaagtcaaagtcggtactccaagtggcttcgttcggacggtacggaaccaaggttcgaccgtcgtacggtcacgacccg

SEQ ID NO: 388086 - DNA, 540 bp, Homo sapiens
  misc_feature: GZ8MTXP02JZ8K9.39.39.D06.1.454.CMB.2.raw
  modified_base (228)..(228): a, c, t, g, unknown or other
  modified_base (350)..(350): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgccccgaaactcttaatttatgtaggttctttcgtcgccctcgtaggggtttctagtcgtcttcnccggctccaagtctggcaacgacggccctccctgacccatcctactacgacctccaagggctaggacggacgaggcctagacttattattgcagctcaatatactgaagtcaaagttggtaactccacgttggcttcggttccgggcgggaacgggcctaaggttcgaccgtcgtacggtcacgaccccg

SEQ ID NO: 388087 - DNA, 537 bp, Homo sapiens
  misc_feature: GZ8MTXP02IIS2A.39.39.D06.1.454.CMB.2.raw
  modified_base (418)..(418): a, c, t, g, unknown or other
tcagtcgcactagtcacgaccggtgctcgattttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttccaacagcatttcaggcagccgaccccgaaactcttaatttatgtagttctttcgtccggccctctacggggtttctagtcgcttctccggctcaagtctcggacaaccgacggcctccctgaccattctctagactcaggtctgaggacgngctgactagttattgcagctctatatactgaagtcaagtagtactccacgttcggacttcggttacggcggacgggtaacctaaacggttcgaccgttacgtacggttaccacgacccg

SEQ ID NO: 388088 - DNA, 548 bp, Homo sapiens
  misc_feature: GZ8MTXP02JOXA1.39.39.D06.1.454.CMB.2.raw
  modified_base (229)..(229): a, c, t, g, unknown or other
  modified_base (350)..(350): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagctattcaggcacgccgaccccgaaatcttaatttatgtagttctttcgtcgccctgtacgggtttctagtcgcttcnccgctccagtctggacacgcgcctcctgacctatctctacgactcgaggctggacggacgaggtctagtactattagtcgcagtctacattactactagtaagtacaaagttcggtactaccgagttcggacttcggttaccgggcggtaacgggaaccgtaggttacggacccgtacgtacggtacacggtaccccg

SEQ ID NO: 388089 - DNA, 507 bp, Homo sapiens
  misc_feature: GZ8MTXP02GJ69C.39.39.D06.1.454.CMB.2.raw
  modified_base (228)..(228): a, c, t, g, unknown or other
  modified_base (382)..(382): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccanagtgacgttggtgcttataattatgttctcctggttccaacagcattcagcagccgaccccgaaactcttaatttatgtaggttctttcgtcgccctgtaggggtttcctagtcgtcttctccggctccagtctggcacacgccctcctgaccntctctacgacctcaggctggacgacgagctagacgtatttattgcagctacatatactgaagtcaagtgtactccatgactgttcgcggaggacaagttcgaccgtcgtaggacacgcctaacgg

SEQ ID NO: 388090 - DNA, 899 bp, Homo sapiens
  misc_feature: GZ8MTXP02H2CVB.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcacctcctcactcagggcacagggtcctgggcccagtctggcctgacacagcctgccctccgtgtctgagactcctggacagtcgatcaccatctcctgcactggaaccagcagtgtacgttggtgtcttataattatgtcttcctggttaccaacagcattcaggcacgcccgaccccgtaaaacttacgtttaaatttagtaggttaacggtttccttttaccggtcccggtcccccgttacggttaaccgggggtttttccttaacggttcccgtccgtttttcccgttcccggggtccttacccgtaaaacggtttccgttacgggtaacccaaaacccgtacccccgggggtccccctttacccccgtaccgtaaaccccctaactttcccgtttacccgttaaaccgggtacccctttaccccggaaacgggggtcccgtttacggggaaaaccgggggtacccgggaaaacgggggtcccgtttaacgggtaaacccgttttaaattttttaaacgtttccgggaaccttaaccggttaccttaacccgtaaagttttaaaccgtttaaaccgttaaggttaaaacggtttaccctaaaaaaggttttcggggttaaaacctttcccccggtaaacgtttacggggtacccggtttcggggtttacccgggggaccgggggtaaaccggggttaaacccgttaaacggggtttaacccggttaaccccggttaccggtttaaccgggttaccgtaaaccccggtaacccccggg

SEQ ID NO: 388091 - DNA, 542 bp, Homo sapiens
  misc_feature: GZ8MTXP02GK5I7.39.39.D06.1.454.CMB.2.raw
  modified_base (432)..(432): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaaactcttaatttatgtaggttctttcgtcggccccttcgtacggggtttctagtcgctttcgtcccggcttcccgaagttcctgggaccaaccgacggccctccctgacccatctctagactccaggctgaggacgnggctgacttattatgcagctcattatactgaaagtcaaatcggtactccatggctcgttcgggacggaagggaacctaaggttcgaccgtccgtaaggtccacgtacccg

SEQ ID NO: 388092 - DNA, 522 bp, Homo sapiens
  misc_feature: GZ8MTXP02HE1PY.39.39.D06.1.454.CMB.2.raw
  modified_base (268)..(268): a, c, t, g, unknown or other
  modified_base (300)..(300): a, c, t, g, unknown or other
  modified_base (361)..(361): a, c, t, g, unknown or other
  modified_base (438)..(438): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgtccaangcatcagcagcgaccccgaaatctaaatttangagtctttacgcgcctgacgggtttctagtcgcttctccggctccgaagtctggacaaacncggccctccctagaccatctctagactccaggctgaagacgaggctagactattatgcatctcatatatagtaatanaataggtatacctaactaggtcgtgttcggtacggaacgggaaccgtaaacgtacgtaccgtaccgtacggtacgacgaacccg

SEQ ID NO: 388093 - DNA, 544 bp, Homo sapiens
  misc_feature: GZ8MTXP02IODQW.39.39.D06.1.454.CMB.2.raw
  modified_base (354)..(354): a, c, t, g, unknown or other
  modified_base (376)..(376): a, c, t, g, unknown or other
  modified_base (390)..(390): a, c, t, g, unknown or other
  modified_base (417)..(417): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactcttaaatttatgtaggttctttcgtcggtccctcgtaggggtttctagtcgctttcnccggtctccaagtctggcaacncggcctcctgaccntctctacgctccgagctggaacgacgngctgactattatgcagctcatactactgtaaacgtcaaattcggacttacccgatcggtacttcggttccgggcggaacgggaaccgtaaggttccgacccgttccgtacggtccaacgtaccccgg

SEQ ID NO: 388094 - DNA, 720 bp, Homo sapiens
  misc_feature: GZ8MTXP02GY3P8.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcggcccaggagtggtgaagccttcggagaccctgtccctcacctgcgctgtgtctggacgcctcccgtcggcggagatgaatggtggagttgggtccgccgacggcccccgagggaacgggctggaggttggattggtagaaagtaagtggaggaccggggacaaccaactacaatcgccgtcccgtcgagggtcgagtcacatatctgcagacaacgtaccaaacgaaccctacttcctaccctagacggcctacgaccccttcgtcgtcgaccccggtccggaccggtacgtccgggacctaagttaacttattagttgtcgtacgtaagttagtttttagacgtaaggtagttcggttgggggtacggttacgtacggtaacggtcggtacgggggtacgaaaggggtacgttaccggtacgggtcaacggttccggtcccttacccgtaccgtaccgtaccccgttacccgaaacccggaacccggggacccctaacggttccccggtttcccccgttcccccgtcgggtccccgtcccgtccggtccccttacccggaacggtaccgacccgtaaccccgtccggaaccgaccgacccgaacccgg

SEQ ID NO: 388095 - DNA, 530 bp, Homo sapiens
  misc_feature: GZ8MTXP02HB941.39.39.D06.1.454.CMB.2.raw
  modified_base (324)..(324): a, c, t, g, unknown or other
  modified_base (340)..(340): a, c, t, g, unknown or other
  modified_base (360)..(360): a, c, t, g, unknown or other
  modified_base (415)..(415): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccagcagtgacgttggtgcttataattatgtctcctgttccaacagcattcagcagccgaccccgaaaatcttaaatttatgagttctttcgtcgcctnacggggtttctagtcncttctccgctcatctgcacncgcctccctgacatctctagactcagctagagacgagctagtactattattcganagtctacataatactagaaagtacaagttacggtactaccgtactggtcgttcggttaccggacgggtaacggaaccgtaaggttacgaccgtccgtacggtacacgaaccccgg

SEQ ID NO: 388096 - DNA, 518 bp, Homo sapiens
  misc_feature: GZ8MTXP02JMZMS.39.39.D06.1.454.CMB.2.raw
  modified_base (303)..(303): a, c, t, g, unknown or other
  modified_base (321)..(321): a, c, t, g, unknown or other
  modified_base (412)..(412): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcatcaccatctcctgcactggaaccagcagtgacgttggtggttataactatgtctcttggtaccaacatcaccaggcaaagtccccaaactgatgatttangagtcaactaaacgcctnaggggtttcaatcgtctctctggctcagtctggacacacggcctcctcgacatctctcgggctcgagcgtgaggacgagctctctaatttntgcactctactataactacaacatatatcgtacgttggtcggtacggacggacggaccgtacgtacgtacgtcgtacgtacgacgaccgacggtccgtccgtcccg

SEQ ID NO: 388097 - DNA, 687 bp, Homo sapiens
  misc_feature: GZ8MTXP02G4NH8.39.39.D06.1.454.CMB.2.raw
  modified_base (277)..(277): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccaggtctgggcctgacacagcctgcctccgtgtctgagactcctggacagtcgatcaccatctctgcactgaaccagcagtgacgttggtgcttaataattactgtctcctggttaccaaacgngctatcagcacgacccgaaccctaaattactttaatttagtgtacggtttccgtttccggtccggtccgttacggtacgggtttactacgttccgtcttccgtaccgcttccgtagtcgtacgaccaaccgtcccgtccctaccgtacgtaccctactcctacgtacgtacccgtacgacggtcgtacggaacggacggtacgtacgttaacgttaaacgtttagtttacgttcgtacgtacgtacgtacgttaacttaacgtaacgtaacgtaaacgtaacgtaaacgttaacggttacgttaccgtacgtacggttacggttacgggttaccgggtacgggtaacgggtaaccggtaacggttaaccggtaccggttaccggtacggtaccggtaaccggtaacccgg

SEQ ID NO: 388098 - DNA, 522 bp, Homo sapiens
  misc_feature: GZ8MTXP02IVGZJ.39.39.D06.1.454.CMB.2.raw
  modified_base (229)..(229): a, c, t, g, unknown or other
  modified_base (378)..(378): a, c, t, g, unknown or other
  modified_base (385)..(385): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatgtctcctggttccaacagcattcagcagccgaccccgaaatcttaatttatgagttctttcgtcgtcctcgtacggggtttctagtcgtcttctccggctccaagtctggcacacggcctcctnaccatcnctagctcgaggctgacggacgaggctgacttagttattgcagtctcaatatactgaaagtcaagttcggtatccgacttcggcttcggttcggacggtaggaacccgtagttcgaccgtctacggtccacgtacccg

SEQ ID NO: 388099 - DNA, 591 bp, Homo sapiens
  misc_feature: GZ8MTXP02J0G42.39.39.D06.1.454.CMB.2.raw
  modified_base (229)..(229): a, c, t, g, unknown or other
  modified_base (253)..(253): a, c, t, g, unknown or other
  modified_base (304)..(304): a, c, t, g, unknown or other
  modified_base (361)..(361): a, c, t, g, unknown or other
  modified_base (372)..(372): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctgccctgactcaggctgccctccgtgtctgggtctctaggacagtcatccaccatctcctgcactggaaccngcagtgacgttggggttatgatangtctctgtaccagcaatatccaggcacacgacccccaaatcatctatttangtaggtcagtaatccggcctcgtaggggtttctaatcgtcttctctggctccaagtntcggacaaacncggccctccctcgaccctactcctcgtcgggcctcgacggcctagggacggacggaggtcctaggtaatttacttaacgtcgtacaacggtccttacgttagtttaccgactaaacgtcgtaaggttcggacggtactttatggttacgttacgggaaacggtttacgggaacccgtaaagggtcctacgttaccggtccgttaacgggtccaacccgg

SEQ ID NO: 388100 - DNA, 634 bp, Homo sapiens
  misc_feature: GZ8MTXP02G4K48.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttccaangctatcaggcacgccgaccccgtaaaattctttaaatttagtggtaggttcctttccggtccggtccccttgtaacggggttttctagtcgtcctttccgtcccggtctcccgtaagtcgtacggacctaaaccgccggtcccctcccgtacgaccctacgttcctacgtaacgaccctccgaggcctaggacggacgagctagtacttattacgtgactagctacattacgtactagtaacgtacaaagttcggtactaccgaacgttcgggtacttcgggttaccgggacggggtaacggtaacccgttaaagggttccggaacccgtttaccgtaacgggttacccgaacggtacccccgg

SEQ ID NO: 388101 - DNA, 537 bp, Homo sapiens
  misc_feature: GZ8MTXP02JPTAN.39.39.D06.1.454.CMB.2.raw
  modified_base (359)..(359): a, c, t, g, unknown or other
tcagtcgcactagtcacgaccggtgctcgatttagtgacatctcgcagttctttgggggggttctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgtaccaacagcatcagcagcgaccccgaaatcttaatttatgtagttctttcgtcgcctgtacgggttctagtcgcttctccgctcgagtctgcaacncgtcctcctcgaccatcctctacgactccgagctaggacgacgaggctagacttattacgttgacagtcctatatatactagtaacgtactaatcggtactccacgttggacgttcggttcgggacggtaacgggtaacctaacggttacgaccgttacgtaacgtcgacgaaccccg

SEQ ID NO: 388102 - DNA, 525 bp, Homo sapiens
  misc_feature: GZ8MTXP02IRFXU.39.39.D06.1.454.CMB.2.raw
  modified_base (271)..(271): a, c, t, g, unknown or other
  modified_base (305)..(305): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcacactcctcactcagggcacagggtcctgggcccagtctggcctgacacagcctgcctccgtgtctgagactcctggacagtcgatccaccatctcctgcactggaaccagcagtgacgttggtgcttataattatgtctctggttccaacngcatcaggcagccgaccccgtaaatcttaatttngtagtctttcgtcgtccctcgtagggtttctagtctcttccgtccggctccaagtctggccaacgcggtccctcccgtgacccatctctagactccgaggctgacggacgaggctagtacttattatgcagctctatatacgtagaatcaaatcggtatcctagtggtcgttacggtcggacggaaggaccgtaagtcgacccgtcgtacggtactacgg

SEQ ID NO: 388103 - DNA, 533 bp, Homo sapiens
  misc_feature: GZ8MTXP02G7SI8.39.39.D06.1.454.CMB.2.raw
  modified_base (255)..(255): a, c, t, g, unknown or other
  modified_base (269)..(269): a, c, t, g, unknown or other
  modified_base (302)..(302): a, c, t, g, unknown or other
  modified_base (338)..(338): a, c, t, g, unknown or other
  modified_base (377)..(377): a, c, t, g, unknown or other
  modified_base (426)..(426): a, c, t, g, unknown or other
  modified_base (431)..(431): a, c, t, g, unknown or other
  modified_base (436)..(436): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctctgcactggaaccagcagtgacgttggtgcttaataattngtctctgtaccaangcatcaggcagccgaccccgaaatcttaaattngtagttctttcgcgtccctgtacggggtttcagtcncttcgccggctccgaagtctggacaacgccggcctcccngaccatctctacgactcgagtctaggacgacgagctgaacttattagtnacgancctanattatactagaagtacaatcggtactccgtaactggtacttcggtcggacggaacgggaacctaaggtcgtaccgtcgtacggtccgaacgaccccg

SEQ ID NO: 388104 - DNA, 572 bp, Homo sapiens
  misc_feature: GZ8MTXP02I5331.39.39.D06.1.454.CMB.2.raw
  modified_base (233)..(233): a, c, t, g, unknown or other
  modified_base (274)..(274): a, c, t, g, unknown or other
  modified_base (311)..(311): a, c, t, g, unknown or other
  modified_base (451)..(451): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctggggcccaggtcctaggcctgacacagcctgcctccgtgtctgagactcctggacagtcgatcaccatctcctgcactggaaccngcagtgacgttggtgcttatattatgtctcctgttccaacngtcattcaggcagccgaccccgaaactcttaatttangtagttcttcgtcgcctcgaggggtttctagtcgcttctccggctccaagttctggaccaacgacggtccctaccctgaccctatcctactaacgcctaccaggcctgaggacgaggtctgtaacttattagtgactacnctactactaactacgtagtaacgtacgtaagtacgtacgtaccgtacgtacgtacgttcggtacggtacgggtacggtaaccgtaacggtacgtaccggtaccgtacgtaccgacgtaccg

SEQ ID NO: 388105 - DNA, 496 bp, Homo sapiens
  misc_feature: GZ8MTXP02GMXZQ.39.39.D06.1.454.CMB.2.raw
  modified_base (367)..(367): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgaggttctttcgtcgccctcgacggggtttctagtcgcttctccggctccaagtctggcaacncggcctccctgaccatctctagactccaggctgagacgagctgactattatgcagctcatatactgaagtcaatgtactcacgtgctgtcggcggaggaaccagttcgaccgtctacggtcacgacccg

SEQ ID NO: 388106 - DNA, 551 bp, Homo sapiens
  misc_feature: GZ8MTXP02JUYSX.39.39.D06.1.454.CMB.2.raw
  modified_base (305)..(305): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctcctgtaccagcaatatccaggcacacgacccccaaactcatcatttangagtcaagtaatcgcctcgtagggtttctaatcgtcttctctcggctacctaagtcgtaggaccaacgaccggtccctaccctagaccctatcctcgtcggcctaccgagcgtaggaggacgaggtctagtattactactgcagtcctataagttgaactaagtcgtaagtgtaggtactttagtcgttacgttacgggaagtacgggtaacctaggtactacgtccgtaccgtacggaccaaccg

SEQ ID NO: 388107 - DNA, 580 bp, Homo sapiens
  misc_feature: GZ8MTXP02IIJWF.39.39.D06.1.454.CMB.2.raw
  modified_base (227)..(227): a, c, t, g, unknown or other
  modified_base (244)..(244): a, c, t, g, unknown or other
  modified_base (269)..(269): a, c, t, g, unknown or other
  modified_base (379)..(379): a, c, t, g, unknown or other
  modified_base (383)..(383): a, c, t, g, unknown or other
  modified_base (387)..(387): a, c, t, g, unknown or other
  modified_base (414)..(414): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccngcagtgacgttggtgtnttaataattatgtctctgttccaangcatcaggcacgccgaccccgtaaattctttaatttatgtagttctttcgccgtcctgtacgggtttctagtctcttctccgctcgagtctggaccaacgcggcctcccngacnttcnctagcctccgaggtctaggacggacgngcctagaactttagtttatgaccagtcctacaattactacgtagtaaatacaaggttcggttaactacccgtattacgggcgtttcgggttaccgggacggtaaaccgggaaccgttaaacggttcggtaacccggttccgtaaacggtcccaaacggtaccccgg

SEQ ID NO: 388108 - DNA, 549 bp, Homo sapiens
  misc_feature: GZ8MTXP02JE6A0.39.39.D06.1.454.CMB.2.raw
  modified_base (460)..(460): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaatcttaaatttatgtagttctttcgtccggccctcgtacggggtttctagtcgtctttcgtccggctccgaagtcgtggaccaacgacggtccctccctcgaccctatcctactacgacctccacggctggacggacgaggtctagtaactattatgctagctanatatactagaagtcaaagttcgtaactccacgtggtcttcggtacggacggacggaacctagttcgaccgtctacggtacacgtacccg

SEQ ID NO: 388109 - DNA, 538 bp, Homo sapiens
  misc_feature: GZ8MTXP02IQG6L.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaacagcattcaggcagccgaccccgaaactcttaatttatgaggttctttcgtcggtccctcgtaggggtttctagtcgtcttctccggctccaagtctggcacacggcctcctgaccatctctagacctcaggctgacggacgaggctgacttattattgacagctcatatactgaagtcaagtacggtatccacgtcggacttcggttacggcgggtaacgggaacctaaaggtttcgaaccgttccgtacggtccacggtaccccg

SEQ ID NO: 388110 - DNA, 535 bp, Homo sapiens
  misc_feature: GZ8MTXP02JUVYB.39.39.D06.1.454.CMB.2.raw
  modified_base (364)..(364): a, c, t, g, unknown or other
  modified_base (374)..(374): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgtagtctttcgtcgccctcaggggtttctagtcgcttctccgctccagtctgcacncggcctcccngaccatctctagctccagctgagacgagctgactattatgcagctcatatactgtaagtcaagttcggtaaactccacgttcggcttcggtccgggtaacgggacgggtaaccgtaaggttacggtacccgttaccgtacggttaccgacggaacccccgg

SEQ ID NO: 388111 - DNA, 546 bp, Homo sapiens
  misc_feature: GZ8MTXP02ICGF5.39.39.D06.1.454.CMB.2.raw
  modified_base (243)..(243): a, c, t, g, unknown or other
  modified_base (270)..(270): a, c, t, g, unknown or other
  modified_base (384)..(384): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggtccaangcattcaggcagccgaccccgaaattcttaaatttatgtagttctttcgtcggtcccctgtacggggtttcagtcgcttctccggctccaagtctggacaacgcggccctcccngaccatcctctagaccctcgaggctaggacggacgaggctagacttatttatgacagctactattatactagaatactaaagtcggtaactccgaacgttggcttcggttcgggacggtaacggaacctaggtcgtacccgtacgttacggacacggacccg

SEQ ID NO: 388112 - DNA, 559 bp, Homo sapiens
  misc_feature: GZ8MTXP02FW7H2.39.39.D06.1.454.CMB.2.raw
  modified_base (343)..(343): a, c, t, g, unknown or other
  modified_base (378)..(378): a, c, t, g, unknown or other
  modified_base (440)..(440): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctcctggttccaacagcattcaggcagccgaccccgaaatcttaatttatgagttcttcgcgtcctcgacgggtttcagtcgcttcnccggctccaagtctaggcctaacacggccctcccngacccatcctctagacctccgaggtcctgaggacgagcctagacttattattgacagcctanatatactaggaaattcaaagttcggtaactccctaagttgtccgttggttaccgggcgggtaacggtaaccgtaaacggtttcggaccccgttacggtacggtaccgtacgaaccccgg

SEQ ID NO: 388113 - DNA, 624 bp, Homo sapiens
  misc_feature: GZ8MTXP02G2QWF.39.39.D06.1.454.CMB.2.raw
  modified_base (229)..(229): a, c, t, g, unknown or other
  modified_base (272)..(272): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccngcagtgacgttggtgcttataattatgtctcctgttaccaacngcattcaggcagccgaccccgaaactcttaatttatgtaggttcttcgtcggtcctgtacggggtttctagtcgtcttcgtccggtctccgaagtctggaccaaccgacggtcctcccgtgaccctactctactacgaccttccgaggtctaggaacggacgaggctgtacttattagtgactagtctactaattaatacgtagtaacgtactaagttacggtactaccgtaaccggttggtccgtttacggggttaccgggaacggggtaacggggtaacccgttaacgggtttacccgggaaccccggtttacccggttaacggggttacccgtaaccggtaacccccgg

SEQ ID NO: 388114 - DNA, 646 bp, Homo sapiens
  misc_feature: GZ8MTXP02GF8LW.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatcctcctgcactggaaccagcagtgacggttggtgtcttaataattatgtctcctggttaccaacagcattcaggcacgcccgaccccgtaaaattcttaaatttagtgtacggtttcctttcgccggtcccttaggtacggggtttctacgtcgtctttcgccgctccgagtctaggaccaacgccgtccctccctacgaccctatctctacgacctccgaggtcgtacggaacggacggtgtaccgttaggtaaacctttaatttagttcgacgtacgtccttactaattaactacgtagaaacgttactaaagttacggtaacttaccgtacgttcggtcgttacgggttaccggggacgggtaaacgggtaacccgttaaaggttcccggtaacccggttaccgttacggtaccgaaccggtaaccccgg

SEQ ID NO: 388115 - DNA, 660 bp, Homo sapiens
  misc_feature: GZ8MTXP02HZML5.39.39.D06.1.454.CMB.2.raw
  modified_base (183)..(183): a, c, t, g, unknown or other
  modified_base (230)..(230): a, c, t, g, unknown or other
  modified_base (273)..(273): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacgagggtcctgggcccagtctggcctgacacagcctgcctccgtntctgagacctcctggacagtcgatcaccatctcctgcactggaaccngcagtgacgttggtgcttataattatgtctcctggttaccaangctattcacggcacgacccgaccccgtaaacttacttaatttataggtaagttcctttaccgtccggtccccgtacgttaccgggggtttctacggtccgtccgtttctcccggtccttcccgtaagttctacggaccaaaccgccggtcccctcccgtacgacccacttcctacctacgacctaccgaaggccgttaggaacggtacgaggtcgtacgtaacttagtttaacttgacgtacgtctaactaattacgtaaccgtaagtaaacgtacgtaaaagttcggtaaaacttccgtaaacgttcggtcgttacggttaccgggacggaacgggtaaccgtaacgtaccggtacccgttacgtaacggttaccacggaaccccg

SEQ ID NO: 388116 - DNA, 529 bp, Homo sapiens
  misc_feature: GZ8MTXP02I60TY.39.39.D06.1.454.CMB.2.raw
  modified_base (409)..(409): a, c, t, g, unknown or other
  modified_base (420)..(420): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagcgaccccgaaaactcttaatttatgagttctttcgtcgccctcgtacggggtttctagtcgtcttctccggctccaagtctggccaacgacggcctccctcgacctatctctacgactccacgctgngaaaaaaacgngctagactattatgcagctcatatactagtaagtacaatagtactacacgtgtcgtcgtcggcggacggaaccgtaacgttacgtaccgtacgtacggtcgacgacccg

SEQ ID NO: 388117 - DNA, 559 bp, Homo sapiens
  misc_feature: GZ8MTXP02JDA6R.39.39.D06.1.454.CMB.2.raw
  modified_base (228)..(228): a, c, t, g, unknown or other
  modified_base (306)..(306): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaatcttaaatttntgtagttctttcgtcgccctcgtacggggtttctagtcgtcttcgtccggctccaagtctggaccaacacggccctccctgacccatcctactacgacctcaggcctggaggacgaggcctgaacttattattgacagctcatatacgtagaagtacaattcggtaactcccgattcgggacttcggttacgggcggaacggggtaaccctaaaggttcggtaacccggtcgtacggtaccgacgaaccccgg

SEQ ID NO: 388118 - DNA, 634 bp, Homo sapiens
  misc_feature: GZ8MTXP02IWGPB.39.39.D06.1.454.CMB.2.raw
  modified_base (228)..(228): a, c, t, g, unknown or other
  modified_base (270)..(270): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataattatgtctctgttccaacngcattcaggcacgccgaccccgaaattctttaaatttatgtagttctttcgtccgtcccttcgtacggggtttctacgtcgtcttcgtcccggtcttccgaagttctcggacaaccgaccggtccctacccgtgaaccctatcctactacgacctaccgaggtctaggacggacgaggtctagtaaccttatttagtcgctacgcctactaagttaactaccgtagaaacgtacgtaaaagttcggtaactcccaacggttgggtaccgttcggggttaccgggaccggggtaaacggggtaaccccgttaaaggttccggtaaccccggttaccgttaacgggtaccgaaccggtaaccccgg

SEQ ID NO: 388119 - DNA, 523 bp, Homo sapiens
  misc_feature: GZ8MTXP02IZQ95.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgacccccgaaatcttaatttatgagttctttcgtcgccctcaggggtttctagtcgtcttctccggctccaagtctggccaacacggcctccctgaccatctctagactccaggctaggaggacgagtctgacttattattgacagctcatttgactaatcagtgacggtctttaatgtcgttacggaagtcgggaacctaaggtcacgttcgtacctaggtccacgtacccaaacgg

SEQ ID NO: 388120 - DNA, 625 bp, Homo sapiens
  misc_feature: GZ8MTXP02F7Y94.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgtccaacagcattcaggcagccgaccccgaaactcttaatttatgacgttctttcgtcgtccctcgtacggggtttctagtcgtcttctccggctccaagtctggaccaacgaccggccctccctacgaccctacttcctactacgtaccttaccgacggtcctaggacggaacggtggacccttggaaacctttatttaacgttcgtacgtacgtacctactaattactaaacgttgaaaacgttctaaaagttggttaacctaccgtaacgttcggtaccgtttcggtttacggggcggggtaacgggaacccgttaaaggttccggtaaacccggttccgtacggtaccgacggaacccgg

SEQ ID NO: 388121 - DNA, 688 bp, Homo sapiens
  misc_feature: GZ8MTXP02H6P0J.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgtaggttctttcgtccggtccctcgtacggggttttctaggttcgtcctttcgtcccggtcttcccgtaagttccgtgggaccctaaccgaccgggtcccttaccccgtacgaccctacttcctactaacggacccttaccgacggtccttggaacgggacgaagggtcctaggtaacctttaatttaacgttcggacctaggtacccttacgaattaacttaaaccgtagtaaaacgttacctaaaagttacgggttacttacccgtaacgttcgggtacctttcgggtttacccggggcggggtaaacggggtaacctaaacggggtttacggaaccccggtttaccgtaacggggtttacccaaccggtaaccccgg

SEQ ID NO: 388122 - DNA, 544 bp, Homo sapiens
  misc_feature: GZ8MTXP02HDPA3.39.39.D06.1.454.CMB.2.raw
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcacgccgaccccgaaaacttcttaaatttatgtaggttctttcgtccgcctcgtacggggtttctagtcgtcttctccggctccagtctgcaacgcgcctcctgaccatctctagacctcaggctagaggacgagctagtacttatttatcgacagtctctaatactactagtaacgtacaaagttggtactaccgacgttcggcgttcgttacgggacggagggaacctaaggtccgtaaccgtcgtacggtacacgacccg

SEQ ID NO: 388123 - DNA, 514 bp, Homo sapiens
  misc_feature: GZ8MTXP02JN9H6.39.39.D06.1.454.CMB.2.raw
  modified_base (341)..(341): a, c, t, g, unknown or other
  modified_base (434)..(434): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagcgccccgaaactcttaatttatgagttctttcgtcggccctcacggggtttctagtcncttctccggctccaagtctggcacacggcctccctgaccatctctagactccaggctagacggacgaggctggactattatgcagctacatanactgaagtcaaatcggtatccgactggcttcgtcggcggagggaacctaaggttcgaccgtcgtacggtccacgtacccg

SEQ ID NO: 388124 - DNA, 548 bp, Homo sapiens
  misc_feature: GZ8MTXP02JGQ4Y.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaactcttaatttatgagtctttcgtcgcctcacggggtttctagtcgcttctccggctccaagtctggcaacacggcctccctgaccatctctagacctcacgctgacggacgagctgactattattgcagctcaattactatgaaagtcaaagttcggtactcctaacgtggtaccttggttccgggcgggaacggggtaacccgtaaagggtttcgaacccggttccgtaaacggttccgaacggtaccccgg

SEQ ID NO: 388125 - DNA, 599 bp, Homo sapiens
  misc_feature: GZ8MTXP02I4Y6A.39.39.D06.1.454.CMB.2.raw
  modified_base (229)..(229): a, c, t, g, unknown or other
  modified_base (255)..(255): a, c, t, g, unknown or other
  modified_base (267)..(267): a, c, t, g, unknown or other
  modified_base (303)..(303): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatntctctgtccaangcatcaggcacgccgaccccgtaaatcttaaatttntgtacgttctttcgtccgtcccttgtacggggtttctagtcgtccttcgtccggtctcctagtcgtacgaccaaccgccggtccctcccgtacgaccctactcctactacgtaccctccgacggtctacgggacgggaccgaggtctagtaacttatttagttcgactacgtacctactattaacgtacgtagaacgtacaagttcggtactccgtacgtcggtcttcggttcgggacggtaaacggtaaccgtaaaggttccgtaaacccgtcgtacgggtaccacggaacccgg

SEQ ID NO: 388126 - DNA, 630 bp, Homo sapiens
  misc_feature: GZ8MTXP02JQ4HZ.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgttccaacngcattcaggcagccgaccccgaaactcttaaatttatgtaggttctttcgtcggccctgtacggggtttctagtcgtcttcgccggtctccgtaagtctaggaccaacgaccggcctccctagacctactctactacgacctccgaggctaggacggacgagggtcctagtaaccttattaacgttgaccagtctactaattacgtaacttagaaagtacctaaaagttcggttaaaactcccgtaaacgttcgggtacgttcgggtttaccggggaccggttaaacggggaaccccgtaaaagggtttccggtaaacccggttaccgtaacggggtttaccgaaccggtaacccccggg

SEQ ID NO: 388127 - DNA, 540 bp, Homo sapiens
  misc_feature: GZ8MTXP02ISCN5.39.39.D06.1.454.CMB.2.raw
  modified_base (305)..(305): a, c, t, g, unknown or other
  modified_base (321)..(321): a, c, t, g, unknown or other
  modified_base (369)..(369): a, c, t, g, unknown or other
  modified_base (398)..(398): a, c, t, g, unknown or other
  modified_base (441)..(441): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccaaatcttaatttangagtcttcgtcgcctntacggggtttcagtcgtcttctccggctcctaaagtctacggcaaacncggccttcccagacccattcctactaacnctacgagtcgtagacgacgacgacgtagtactattatagacanctactatatactagtaatataagtacgtactactacgtacgtcgtcgtacggtacggacggtaacgtaacgtacgtacgtacgtacgtacgtacgaccg

SEQ ID NO: 388128 - DNA, 559 bp, Homo sapiens
  misc_feature: GZ8MTXP02ICS33.39.39.D06.1.454.CMB.2.raw
  modified_base (229)..(229): a, c, t, g, unknown or other
  modified_base (242)..(242): a, c, t, g, unknown or other
  modified_base (267)..(267): a, c, t, g, unknown or other
  modified_base (352)..(352): a, c, t, g, unknown or other
  modified_base (359)..(359): a, c, t, g, unknown or other
  modified_base (368)..(368): a, c, t, g, unknown or other
  modified_base (417)..(417): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgngcttataattatgtctctgtccaangctatcagcagccgacccgaattcttaatttatgtagttctttcgccgtcctgtacgggtttcagtcgcttcgtccgctcagtcncgacacncgcctcccngaccatctctacgacctcgaggtctagaggacgaggctagtacttattntgacagtctactagttactacgtagtaacgtactaaaagttcggtaactccgtaacgttcgggtacttcgggttccggggacggtaacgggtaacccgtaggttaccgtacccggtaccgtacggtacctaacggaccccgg

SEQ ID NO: 388129 - DNA, 671 bp, Homo sapiens
  misc_feature: GZ8MTXP02HH9KO.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaangctattcaggcagccgaccccgaaaacttcttaaatttatgtagttcctttcgtccgccctgtacggggtttctagtcgtcttctcccggctccgtaagtctggaccaaccgccggccttcccgtacgactactacctcgtactaccgtcccgacggcgtacggaacgggacgacgggtacttacgggtaaactttacgttttaagttcgacggtaccgtaccttacgtattaaaccttaacgttaaggtaaacggttacttaaaacggttaggttacccgttacctaacggtacggttccgttaccgggtttccggggaccggggttaaacggggaacccgttaaaacggttccgggtaaacccggttccgttaaccggtacgtaccggtaaacccccgg

SEQ ID NO: 388130 - DNA, 604 bp, Homo sapiens
  misc_feature: GZ8MTXP02JMSYI.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctggttaccaactagctattcaggcacgccgaccccgtaaacttacttaaatttatgtacgttctttcgtccggtcccttcgtacggggtttctagtcgtcttcgtccggctccaagtctggaccaacgtaccgcctccctcgaccctatctactagacctaccgagctagacggacgaggtctagtacttacttattcgactagctacaacttatactagtaaagtactaagttacggtactacctaacgttcggtaccgttacggttcgggaccgggtaaacgggtaaccgtaacggttaccggtaacccgttacgtaacggtaccgaacggtaaccccgg

SEQ ID NO: 388131 - DNA, 778 bp, Homo sapiens
  misc_feature: GZ8MTXP02G9EZJ.39.39.D06.1.454.CMB.2.raw
  modified_base (244)..(244): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatctcctgcactggaaccagcagtgacgttggngcttataattatgtctcctggtccaacagcatttcaggcacgccgaccccgaaaacttcttaaatttagtggtaggttctttcgtccggtcccttcgtacggggtttctacgtcgtcttcgtcccggctcccgtaagtcgtcggaccaaccgtaccgggtccctccccgtcgtaaccctacgttccgttactaacgtacccttacccgaacgggtccttacgggaaaccgggaaccgggacgggaccgttacggttaaaccgtttaagttttaacgtttcggaccgtaaaggttcccgttaaccgttaaagtttaaacttaaccggttaacggttaaaacggtttaaccctaaaaggtttacgggtttaaacccgtttacccgtaaaccgggtttacgggtcccggttttaacgggggtttcccgggggaccgggggttaaaccggggtaacccggtttaaaacggggtttccggtaaaccccggtttacccggtttaaaccggggtacccgttaaaccggtaaacccccgggg

SEQ ID NO: 388132 - DNA, 597 bp, Homo sapiens
  misc_feature: GZ8MTXP02JUTBZ.39.39.D06.1.454.CMB.2.raw
  modified_base (272)..(272): a, c, t, g, unknown or other
  modified_base (326)..(326): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngacattcaggcagcgaccccgaaactcttaatttatgtagtcttcgtcgccctntacggggtttctagtcgtcttcgtccggctcctaagtctacggacaaaccgccggcccttccctagaccctaactctacctaagtaccctcctacggcttggaacggacgtaggctagacttattattcgctacgtctacctattactactaggaatacaaagttacggtactccgaacgttcggtcgttacggttccggacggtaaacgggggaaccgtaaaacggtttcggaacccggttaccgtacggtaccgtaacggtacccccgg

SEQ ID NO: 388133 - DNA, 563 bp, Homo sapiens
  misc_feature: GZ8MTXP02HCJ78.39.39.D06.1.454.CMB.2.raw
  modified_base (228)..(228): a, c, t, g, unknown or other
  modified_base (366)..(366): a, c, t, g, unknown or other
  modified_base (386)..(386): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgtcttataattatgtcttcctggttaccaacagcattcgaggcacgccgaccccgaaattcttaatttatgtagttcttcgtcgcctgtacggggtttctagtcgtcttctccgctccagttcnggaccacgaccggcctcccngacctatcctctacgcctcgtaggctaggacggacgaggctgtaacttattatcgactagtcctacattactaacgttagaacgtataagttaggtactggactaggtcgtcgttcgggtacggacggaacggtaccgtaaacggttcggaacccgtacggtacggtaccgaaccgg

SEQ ID NO: 388134 - DNA, 638 bp, Homo sapiens
  misc_feature: GZ8MTXP02HMW3L.39.39.D06.1.454.CMB.2.raw
  modified_base (227)..(227): a, c, t, g, unknown or other
  modified_base (268)..(268): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctctgttccaacngctattcaggcagccgaccccgtaaaacttacttaaatttatgtaggttctttcgtccggtccttcgtacggggtttctagtcgtcttcgtcccggtctccgtaaagttcctacgggaccaaaccgtaccggcccttccccgtacgaccctacttcctacgtaacgacccttaccgaacggtctacggaacgggacgaacgggcttacggacttaagtttaagttgacgtagccttacgtaattaacttaacgttagtaaacgtctaaaagttcggtaacttaccgtaacgttcggtacgttcggttacgggacggaagggtaaccgtaacggttacggtacccgtacgttacggaccgtacgaacccgg

SEQ ID NO: 388135 - DNA, 545 bp, Homo sapiens
  misc_feature: GZ8MTXP02HJAZP.39.39.D06.1.454.CMB.2.raw
  modified_base (380)..(380): a, c, t, g, unknown or other
  modified_base (388)..(388): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagccgaccccgaaatcttaaatttatgtagttctttcgtccgcctgtacggggtttctagtcgtcttctccggctccaagtctggcaacgcgcctcccngaccatcnctacgactcaggctagagacgagctgactatttatgacagctacatatactagtaagtacaaagtcggtactaccacgttggtcgttacggttccggacgggaaacggtaaccgtaaaggttacgtacccgttacgtacggtaccgaacggaccccg

SEQ ID NO: 388136 - DNA, 538 bp, Homo sapiens
  misc_feature: GZ8MTXP02IXDPN.39.39.D06.1.454.CMB.2.raw
  modified_base (447)..(447): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagccgaccccgaaatcttaatttatgtagttctttcgtcggcctcgtacggggtttctagtcgctttctcccggctccgaagtctggaccaacgacggccctccctgaccctatctactacgacctccaggctggagacgagctgacttatttagtgctagcctanattagtactagaaagtcaaaagttcggtaactccactggcttggtacggcggaggtaaccaggttacgacccgtctacggtcacgtacccg

SEQ ID NO: 388137 - DNA, 536 bp, Homo sapiens
  misc_feature: GZ8MTXP02F2Z0S.39.39.D06.1.454.CMB.2.raw
  modified_base (228)..(228): a, c, t, g, unknown or other
  modified_base (242)..(242): a, c, t, g, unknown or other
  modified_base (253)..(253): a, c, t, g, unknown or other
  modified_base (263)..(265): a, c, t, g, unknown or other
  modified_base (268)..(268): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtntcttatatatntctctgtcannntcngcacgcgaccaactcttaattatgtagttcttcgcgtcctcgtacggttctagtcgtcttcgtccgtctcagtctacgacaacgacgtcctccctacgacctactcctactacgtacctccgacggtcgtaggacggacgacgtctagtacttattatgactagtctatatatacgtagtacgtacaagtcgtactacgtacgtcggtcgttcggtacggacggtacggaaccgtaagttacgtaccgtacgtacggtacgacgaccg

SEQ ID NO: 388138 - DNA, 584 bp, Homo sapiens
  misc_feature: GZ8MTXP02G3M7M.39.39.D06.1.454.CMB.2.raw
  modified_base (229)..(229): a, c, t, g, unknown or other
  modified_base (269)..(269): a, c, t, g, unknown or other
  modified_base (347)..(347): a, c, t, g, unknown or other
  modified_base (370)..(370): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctgttccaangcatcaggcagccgaccccgaaactcttaatttatgtaggttctttcgtcgcccttgaggggtttctagtcgctttcnccggctccaagtctcggacaacncggcctccctgacccatctctacgacctccgagctagacggacgaggctagtaacttattagtgacagctacaattatactgaaagttcaaagttcggtaactccgtaacgttcggtctttacggggttcccgggacggggtaacggggtaaaccccgttaaaggtttacccggtaacccgttccggtaacggtacccgaacggtaacccccgg

SEQ ID NO: 388139 - DNA, 560 bp, Homo sapiens
  misc_feature: GZ8MTXP02JSCZ2.39.39.D06.1.454.CMB.2.raw
  modified_base (311)..(311): a, c, t, g, unknown or other
  modified_base (354)..(354): a, c, t, g, unknown or other
  modified_base (390)..(390): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaactagcattcaggcacgcgaccccgaaactcttaaatttacngtacgttctttcgtcggcctgtacggggtttctagtcgcttcnccggcttccaagtctggacaacgaccggcctacccngacccatcctctacgacctcaggcctaggacgacgaggtctagtactagttatgcagtctacattactatagtaagtacaaagtggtaatcccgtagtcgggtctggttacgggcggtaagggtaacccgaaaggtttccggacgttaccgtagggtccaaacgtcccgg

SEQ ID NO: 388140 - DNA, 520 bp, Homo sapiens
  misc_feature: GZ8MTXP02FLLL4.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgaggttctttcgtcggccctcgacggggttttctagtcgtcttctccggctccaagtctggcaacacggcctccctgaccatctcagacctccaggctgagacgaggctgactattattgcagctcatatactgaaagtcgaaatggtaatcccagtcggctcggttcggcgggtaggaaccgtaaaggttgacccgtcgtaacggtcacgacccg

SEQ ID NO: 388141 - DNA, 711 bp, Homo sapiens
  misc_feature: GZ8MTXP02GI7UP.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcacatctctgcactggaaccagcagtgacgttggtgcttatattatgtctctggtccaacagcattcaggcacgccgaccccgtaaaacttctttaaatttataggtagtttctttccgtccggtcccttcgtacggggtttctacgtccgtctttccgtcccggtcttccgtaaacgttccgtacgggtacccaaaaccgccgggtcccccttcccgtacgaaccctacttcccgtactacgtaaccgttccgacggtacctaggaacggaacggtacggtacgtacggtaaaccttagtttacgtttacgacgtaacgtcccttataacttaattaaaccgtaggtaaacgttacgtaaagttacgggtaaccttaccctaacggttacgggtccgtttaaggggttcccggggaaccgggggtaaacgggtaaacccgttaaaacgggttaccggtaaaccccggtttaccggtaacgggttaccgtaaccggtaaacccccgg

SEQ ID NO: 388142 - DNA, 551 bp, Homo sapiens
  misc_feature: GZ8MTXP02FMM7A.39.39.D06.1.454.CMB.2.raw
  modified_base (459)..(459): a, c, t, g, unknown or other
  modified_base (501)..(501): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaagggctgagttggattggtgaaataaatgagaccgggggcaccaactacaaatgcgtccctcaggggtcgagtcaccatatctgcagacaagtccaagaacccacttctccctgaggctgacccctctgtgaccgccgcggactcgggccatactattattgtgcgagtagtttttgcaggatcgttggggcgtatcgacgtcgtggggtacaagggatcgacggtcagtcgtcctccncagccctccaccgaacgggcccagtccggtaccttcccccgnggcccgccctcggccctccgaacggacgccaccgtccgacgacgcaaccg

SEQ ID NO: 388143 - DNA, 568 bp, Homo sapiens
  misc_feature: GZ8MTXP02JW5I7.39.39.D06.1.454.CMB.2.raw
  modified_base (231)..(231): a, c, t, g, unknown or other
  modified_base (246)..(246): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (272)..(272): a, c, t, g, unknown or other
  modified_base (288)..(288): a, c, t, g, unknown or other
  modified_base (295)..(295): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatctcctgcacgtggaaccngcagtgacgttggtncttatattntgtctctgtcangcntnagcagccaccctaatnttaattntgtagttcttcgccgtcctgtcggttctgtctcttcgtcgctcgagtctgacacgtaccgcctccacgacctgtcctctaacgccctacgcggtctaggaggacgaggtctagtacttagttagtcgctacgctactattacgtatgtaactatagttcggtaactccgtacggttgtcggttcggttacccggggcggtaaacggggtaaccgttaaacgggttccggtaaccccggtttcgtaccggggtaccgaacgttaacccccgggg

SEQ ID NO: 388144 - DNA, 505 bp, Homo sapiens
  misc_feature: GZ8MTXP02ITBWQ.39.39.D06.1.454.CMB.2.raw
tcagtcgcactagtcacgaccggtgctcgatttagtgacatctcgcagttcttttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgagtctttcgtcgccctcaggggtttctagtcgcttctccggctccagtctggccaacacggcctccctgaccatctctagactcaggctgagacgagctgactattattgcagctcatatactgaaagtcaatcggtatacctactggcttcgttcggacggaggtaaccgagttcgaccgtctacggtcacgacccg

SEQ ID NO: 388145 - DNA, 542 bp, Homo sapiens
  misc_feature: GZ8MTXP02GKH1B.39.39.D06.1.454.CMB.2.raw
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctctgttccaacngcattcaggcagcgccccgaaactcttaatttatgagttctttcgtcgccctcacggggtttctagtcgcttcgtccggctccaagtctggcaacacggcctccctgaccatctactagacctccaggctgaaggacgaggctgactattattgcagctcatatactagaaactcaaattggtaactcctaacttgggccttggttccgggacggaacggggtaacctaaaggtttcgacccggttaccgtaacgggtccaacggtaccccgg

SEQ ID NO: 388146 - DNA, 779 bp, Homo sapiens
  misc_feature: GZ8MTXP02HUXE0.39.39.D06.1.454.CMB.2.raw
  modified_base (301)..(301): a, c, t, g, unknown or other
  modified_base (580)..(580): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcaggcacagggtcctgggcccagtctggcctgacacagcctgcctccgtgtctgagactccgtagacagtcgactccactactcctcctgccacgtacggaaccagcgtaggtcggtacggttggtacttacttaaattaacttgtcgtccttccgttacgtaacccaangtacttacgtcgaacggcaccggaccccgtaaaccccgttaaaatttacgttttaaagtttacgtacggtaacggtttttccctttaccgggtccccgtaccgtttacggggtttaccggggtttttctaccggttcccgttccgttttccgccccggttacttacccggtacgtttccgacggtaaccccaaaccggtccccggtcccttacccggacacccttagttccctaacgtaaccgtcccttacggacggttcgaacggggacggtaaccgnggttactaaacggttaactttagttttacgccgaacgtcctctaacttaattaaccgtaacgttaggtaaactcgttaaaagttcggtaaacctccgtacggttcgggttcgttacggggtaccgggaccgggttaaacggaaaccgtttaacgggtcccgttaaccgacggtttaacgaccgaacccggtaaacccgg

SEQ ID NO: 388147 - DNA, 600 bp, Homo sapiens
  misc_feature: GZ8MTXP02HGDS0.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaacagcagtgacgttggtgcttataattatgtctcctggttccaacagcattcaggcagccgaccccgaaatcttaatttatgtagttctttcgtcgccctgacggggtttcagtcgcttctccggctccgaaagtctggcaaccgcggccctccctgacccatcctctagactcccgaggctaggaggacgacgggtactcggaaacttagttaagttgaccgtaagcctacaattactaacgtagaaacgttcaaaagttcggtaactcccgtacgttgggccgtttcggggtttccggaaccggggtaacggggtaacccgtaaaggtttccggaacccgttccggtaaacggttccgaaccggtaaccccgg

SEQ ID NO: 388148 - DNA, 523 bp, Homo sapiens
  misc_feature: GZ8MTXP02HHG0J.39.39.D06.1.454.CMB.2.raw
  modified_base (229)..(229): a, c, t, g, unknown or other
  modified_base (379)..(379): a, c, t, g, unknown or other
  modified_base (383)..(383): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaaacagcattcaggcagccgaccccgaaacttcttaaatttatgtaggttctttcgtcggccctgtacggggtttcagtcgcttcgccgctcgatctgcacacgcctcccnaccntctcagctcagctgagacgagctgactattatgcagctacattatactagtaagtcaaagtcggtactccgacgtggcttcggtcgggcggacggtaaccgtaaggttacggaccgttccgtaacggtcgaacgacccgg

SEQ ID NO: 388149 - DNA, 545 bp, Homo sapiens
  misc_feature: GZ8MTXP02JKAZF.39.39.D06.1.454.CMB.2.raw
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggtccaacngcattcaggcagcgaccccgaaatcttaaatttatgtagttctttcgcggtccctgtacggggtttctagtcgtcttctccggctccaagtctggcaacgcggccctccctgacctatcctactagacctccaggctaggaacggacgagcgtagacgtatttagtgacagcttacaattatacagtaagttacaaatggtactccgacgtggtcctggttcggacgggtaggaaccgaagtttacggacccgtacgtacggttcacgtacccg

SEQ ID NO: 388150 - DNA, 568 bp, Homo sapiens
  misc_feature: GZ8MTXP02HKT1G.39.39.D06.1.454.CMB.2.raw
  modified_base (229)..(229): a, c, t, g, unknown or other
  modified_base (244)..(244): a, c, t, g, unknown or other
  modified_base (246)..(246): a, c, t, g, unknown or other
  modified_base (253)..(253): a, c, t, g, unknown or other
  modified_base (255)..(255): a, c, t, g, unknown or other
  modified_base (266)..(267): a, c, t, g, unknown or other
  modified_base (295)..(295): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccngcagtgtacgttgtntnttatatntntctctgtacanncatcagcacgccgacctaatcttaattntgtagttcttcgtccgtcctcgtcggttctgtcgtcttcgtccgctccagtctcgaccacgccgtcctccctcacctactctactacgtactcgacgtcgggtagacggacgagtcgtagtacttattagtcgactacgtcctactacgttaactacgtaagtaacgtaactaacgttacgttaactacgtacgtcggtacgttcgggttacgggacggtacggtaaccgtaacggttaccggtaccgttacgtacggtacgaccggtacccg

SEQ ID NO: 388151 - DNA, 578 bp, Homo sapiens
  misc_feature: GZ8MTXP02FXUD9.39.39.D06.1.454.CMB.2.raw
  modified_base (228)..(228): a, c, t, g, unknown or other
  modified_base (265)..(265): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccngcagtgacgttggtgcttatatatgtctctgttccanagcattcagcagcgacccgaaactcttaatttatgtaggttctttccgtcggccctcgtaggggtttctagtcgtcttctccggctccaagtctgaccaacacggcctccctacgacctactctctacgactccgaggcgtagacggtacgaggtctagtacttattagttcgactagtcctactaatacgttaacgtacgaaagttacaaagttacggtacttacccaacgttcggtcgttacggttccgggacgggtaacgggaaccgtaaaggttcgtaaccggttccgtaacgggtcaacggaaccccg

SEQ ID NO: 388152 - DNA, 607 bp, Homo sapiens
  misc_feature: GZ8MTXP02ITA9Z.39.39.D06.1.454.CMB.2.raw
  modified_base (228)..(228): a, c, t, g, unknown or other
  modified_base (264)..(264): a, c, t, g, unknown or other
tcagtcgcactagtcacgaccggtgctcgatttagtgacatctcgcagttctttggggggggtctcaggaggcagcgctctcaggacatctccaccatggcctggactctgctgctcctcaccctcctcactcagggcacagggtcctgggcccagtctggcctgacacagcctgcctccgtgtctgagacctcctggacagtcgatcaccatctctgcactggaacngcagtgacgtggtgcttatattatgtctctgttcanagcattcagcagccgaccccgaactcttaatttatgtagttctttcgtccggtcccttcgtacggggtttctacgtcgtcttccgtccggtctccgtaagttcgtgacctaacgacggccctccctcgacctatctctaacgcctcgaggctagaggacgaggcgtagtacctatttattcggacacgtctctatactaacgtagtaaactaacgtaacgtagggttaaactccgtaaacgtcgggtcgttcgggttaccgggacggggtaacggggtaaccgtaaagggttaccggtaccccggttaccggtaacggtacccggtaacgtaaacccccgggg

SEQ ID NO: 388153 - DNA, 670 bp, Homo sapiens
  misc_feature: GZ8MTXP02IE8EU.39.39.D06.1.454.CMB.2.raw
  modified_base (228)..(228): a, c, t, g, unknown or other
  modified_base (243)..(243): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgtacgttgtntacttaataattatgtctcgttcgttaccaacagctattcgaggcacgcccgaaccccgtaaacttactttaaatttagtacggtacggttccgtttccggtccggtcccgttacggttaccggggttttcctacgttccgtccgtttccgtcccggtaccttaccgtaacgttcgtacggaccaaccgtacccggtcccctacccgtacgaccctacttctacgtacgaccctaccgacggtctaggaacggtacgagtcgtacgtaacttagttagtcgacagtcctactaacttactaacgtagtaacgtactaaagttcgtactaccgtacgtcggtaccgtttcgggtaccgggacgggtaaacgggtaaccttaaacgggttaccggtacccggttaccgtacggtaccaaccggtacccg

SEQ ID NO: 388154 - DNA, 505 bp, Homo sapiens
  misc_feature: GZ8MTXP02JBF95.39.39.D06.1.454.CMB.2.raw
  modified_base (410)..(410): a, c, t, g, unknown or other
  modified_base (421)..(421): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctctgttccaacagcattcaggcagccgaccccgaaactcttaatttatgtaggttctttcgtcggccccttcgtacggggtttctagtcgcttctccggctccaagtctgcaacacggcctccctgaccatctctagcctccagctgagacgngctgactattntagcagctcatatactgaagtcaagtcgtactccacgtgctgttacggcggaggaacagttcgaccgtctaggtacacgacccg

SEQ ID NO: 388155 - DNA, 749 bp, Homo sapiens
  misc_feature: GZ8MTXP02JSOMW.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagccgaccccgaaacttcttaatttatgtagttctttcgtccggtccctcgtacggggtttctaggttcgtcctttcgtcccggtcttccgaagttcgtacggaccaaaccgacccgggtccccttcccgtacgaacccctacttcccttaccgttaacgacccgttacccgacgggtccgttagggaacggggtaccgacggggtacccgttaggtaaacccgtttaatttaacgtttcggaccgtaaacgtcccttacctaactttaattaaaccgttaggtaaaacgttaccgtaaaagtttacggggttaaacttaccccgtaaacgtttcggggtaccgtttcgggggtttacccgggggaccgggggtaaaccgggggtaaccccgttaaaacggggttttccggtaaaacccccggggtttcccggtttaaacggggttacccgaaccgggtaaacccccgg

SEQ ID NO: 388156 - DNA, 610 bp, Homo sapiens
  misc_feature: GZ8MTXP02H7QQ0.39.39.D06.1.454.CMB.2.raw
  modified_base (330)..(330): a, c, t, g, unknown or other
  modified_base (350)..(350): a, c, t, g, unknown or other
  modified_base (465)..(465): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatgaatggtggagttgggtccgcacgccccgagggaagggctgagttggattggagaaataatgaggacgggcaccaactacaatgcgtcctcgaggggtcgagtcaccatatctgcagaacaagtaccaaacgaaccacttcnccctgacggctcgacccctntcgtacgaccgccgcggactccggcctaatactattattgtgcgtagttagttttgacgtaggtactcgtttagggggcgttaagtcggacgttcgtagggggtacaaaggggtntcgacggtcagttcgtcctccgtactacgccctaccgacgaacgggcccctagttcccggttcccttccccccggtggcccgtccccgttcgtccctacccggaagggcccaccgtaccccggtacgaacggcgacccgaaccgg

SEQ ID NO: 388157 - DNA, 576 bp, Homo sapiens
  misc_feature: GZ8MTXP02I2ZAL.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaaactcttaaatttactgaggttctttcgtccgccctctacggggtttctagtcgcttctccggctccaagtctggccaacacggcctccctgaccctatctctagactccaggctgacgacgagctgactattatgcaagtctcattactactagtaacgtataaagttcggtaactcccgaacgttgggtaccttcgggttaccgggcgggtaaacggggtaaccccttaaaaggtttcggtaacccggttcccgtaaggggtaccaacggtaacccccgg

SEQ ID NO: 388158 - DNA, 613 bp, Homo sapiens
  misc_feature: GZ8MTXP02FQADO.39.39.D06.1.454.CMB.2.raw
  modified_base (228)..(228): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccngcagtgacgttggggttatgactatgtctcctggtaccaacaatactccaggcacacgaccccccaaactcatacctaatttatgaacggtacaagtaaactccggtcccctcgtacggggtttactaagtcgtcttctctcgggtcctaccgaagtccgtaggacctaaacgaccggcccttaccctacgaccctattcctcgtcgggcctccgaggtcgtggacggacgaggtcctagtatttattacgtgacacgtctactatttagactaaatccgtaagtcggacggtacttaagttgttaccgtttacgggaaggttacgggaaacccgtaagggttctaacgttaccgttaccgtacggtaccgaaccggaacccccg

SEQ ID NO: 388159 - DNA, 568 bp, Homo sapiens
  misc_feature: GZ8MTXP02JHGKX.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgaccccgaaatcttaatttatgtagttctttcgtcggtccctcgtacggggtttctagtctcttctccggctccaagtctggaccaacgacgcctccctcgacctatctctacgacctccacggtctaggacggacgacggtctagaacttaacttagttcgactaagtctacattaactactagtaacgtacaattcggtactaccgtaacgtcggtcttcggttccggacggaacggtaaccgtaacgttcggtaccgtacgtacggtccgacgaacccgg

SEQ ID NO: 388160 - DNA, 597 bp, Homo sapiens
  misc_feature: GZ8MTXP02I8SN3.39.39.D06.1.454.CMB.2.raw
  modified_base (272)..(272): a, c, t, g, unknown or other
  modified_base (470)..(470): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcagccgaccccgaaactcttaatttatgtagttctttcgtcggtccctcgtacggggtttctacgtcgtctttcgtcccggctccaagtctgcaacgaccggccctccctgacctactcctctacgacctaccacggtctacggacggacgacggcgtacggaaccttatttaattcggctacgcctanattatactgtaaagtacaaatcggtactaccgaacgttcggtacttcgggtttaccggaccggggtaacgggtaacccgtaaaggtttccgaacccggttaccgtacggtaccgtacggaaccccgg

SEQ ID NO: 388161 - DNA, 570 bp, Homo sapiens
  misc_feature: GZ8MTXP02GFYJY.39.39.D06.1.454.CMB.2.raw
  modified_base (453)..(453): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccagcagtgacgttggtgcttataattatgtctccttggttaccaacagcatttcaggcacgcgacccccgaaactcttaaatttatgaggttctttcgtcgccctcgtaggggtttctagtcgtcttctccggctccaagtctggaccaacgacggcctccctgaccctatcctctacgactccaggcctagagacgaggcctgaacttattattgacagcctanattactacgtagaaagtcaaagttggtactaccgtacgtggtccttcggttaccgggcggtaacgggaacctaaggttacgacccggttccgtaaacggtcccaacggaacccccgg

SEQ ID NO: 388162 - DNA, 606 bp, Homo sapiens
  misc_feature: GZ8MTXP02FIVQ6.39.39.D06.1.454.CMB.2.raw
  modified_base (435)..(435): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatctcctgcactggaaccagcagtgacgttggtgcttataattatgtctcctgttccaacagcattcaggcagccgaccccgaaattcttaaatttatgaggttctttcgcgtccctgtacggggtttctagtcgtcttcgtcccggctccgaagtctggaccaaccgacggtccctccctacgaccctactcctactacgaccttccgaggctaggacgacgngacctgaacttattattgacagtcctacaattaactacgttagaaacgttactaaagttacgggtaactacccgtaacgttcgggtactttcgggtttaccgggggaccgggttaacggggaaccgtaaaggttcggtaccccggttcgtaacggtccacggtaaccccgg

SEQ ID NO: 388163 - DNA, 606 bp, Homo sapiens
  misc_feature: GZ8MTXP02G1BKX.39.39.D06.1.454.CMB.2.raw
  modified_base (270)..(270): a, c, t, g, unknown or other
  modified_base (336)..(336): a, c, t, g, unknown or other
  modified_base (341)..(341): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgttaccaanagcatcaggcagccgacccgaaatcttaatttatgtagtctttcgcgcctcgtagggtttcagtcncttcnccgctcagtctggccaacgcgcctccctgaccatctctagcctcgagctagacgacgaggctaggacttagtttatgacatctacaattataccgtagtaaacgttacaaagtttacggttaaactcccgtaacggttcgggttccgtttacggggtttacccggggaccggggttaaaacggggaaccccgttaaaagggtttcccggtaaaccccgggtttacccgttaaacggggttaccccgaacggttaaaccccccggg

SEQ ID NO: 388164 - DNA, 524 bp, Homo sapiens
  misc_feature: GZ8MTXP02HCFC3.39.39.D06.1.454.CMB.2.raw
  modified_base (272)..(272): a, c, t, g, unknown or other
  modified_base (391)..(391): a, c, t, g, unknown or other
  modified_base (469)..(469): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccagcagtgacgttggtgcttataattatgtctcctggttccaanagcattcaggcagtcgaccccgaaactcttaatttatgtaggttctttcgtcgtccctgtacggggtttctagtcgtcttctccggctccgagtctggacacgacggcctccctgaccntcctctagcctcgacggctaggaggacgaggctagtactattatgcagctcatatactagaacgtcaaagtcggtacnccacgtggctggttccggcggaggaacaagttcgaccgtcgtacggtcacgaccg

SEQ ID NO: 388165 - DNA, 540 bp, Homo sapiens
  misc_feature: GZ8MTXP02I1J76.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaaactcttaatttatgtagttctttcgtccgcctcgtacggggtttctagtcgtcttctccggctccgtagtcctggaccaacgaccggccctccctgaccctatcccgtactagaccctcgaggctgaggacgaggtctgactattatgacagctcaatactactagtaatacaattcggtactccacgttgacttcggtcggacggtaggaaccgtagttcgaccgtcgtacggtcacgacccg

SEQ ID NO: 388166 - DNA, 493 bp, Homo sapiens
  misc_feature: GZ8MTXP02I3P99.39.39.D06.1.454.CMB.2.raw
  modified_base (450)..(450): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcacccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaaactcttaaatttatgagtctttcgtcgccctcacggggtttctagtcgcttctccggctccaagtctggcaacacggcctccctgaccatctctagactccaggctgaggacgaggctgactattattgcagctcatatactgaagtcaatggtancactggctgtacgcgaggcaagtcacgtctacggtcagacccg

SEQ ID NO: 388167 - DNA, 584 bp, Homo sapiens
  misc_feature: GZ8MTXP02HO2MA.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcacgccgaccccgtaaaactcttaaatttatgtaggttctttcgtccggtccctcgtacggggtttctagtcgtcttctccggctccgaagttctggacctaacgaccggccctccctgaccctactcctctagacctccaggtctggacggacgaggctagtacttaatttatgcagtctacataatactagaagtcaaaagttcggtaactccgtaacgtggtcttcgggttccggacgggaacgggtaacccgtaaaggttccggtacccggttaccgtacgggttaccgacgaaccccgg

SEQ ID NO: 388168 - DNA, 551 bp, Homo sapiens
  misc_feature: GZ8MTXP02F1HW0.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaactcttaatttatgaggttctttcgtcgccctcgtaggggtttctagtcgtcttctccggtctccaagtctggccaacgaccggcctccctgaccactctctagactccaggctgacggacgaggctagacttagttattgctagctcatatactagaagtcaatcggtaactccgtaatcggcttcggttcgggacggtaacgggaaccgtaaacggttacggtacccgttccgtaacggtccgacggtaaccccgg

SEQ ID NO: 388169 - DNA, 529 bp, Homo sapiens
  misc_feature: GZ8MTXP02HWU9F.39.39.D06.1.454.CMB.2.raw
  modified_base (295)..(295): a, c, t, g, unknown or other
  modified_base (365)..(365): a, c, t, g, unknown or other
  modified_base (434)..(434): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgcagccccagggagggctgagtggatggtgaataatgagacggggcaccaactacaatgcgtccctcaggggtcgagtcaccatatccgnagacaagtccaagaccacttctcctgagctgacctctgtcgaccgcgcgactcggccatactattattgngcgtagtagtttttgctaggtatcgttgggggcggtatcgacgtcgtggggtcaagggtatcgacggtnatcgtctcctcacgcctccaccgaacgggcccacgtcggtcctttccccgcggccgccctcgcctccgaggcgccacctccgagacgcacgacgg

SEQ ID NO: 388170 - DNA, 527 bp, Homo sapiens
  misc_feature: GZ8MTXP02FI2GP.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcacgcgaccccgaaactcttaaatttatgaggttctttcgtcggtccctcgtaggggtttctagtcgcttctccggctccaagtctggcaacacggcctccctgaccatctctagacctccaggtctgaggacgagctgacttattattgcagctacatatactagaagtacaaagtcggtaatccgaactggcttcggttacggcggaggaaccgtaagttcgaccgtcgtacggtcacgacccg

SEQ ID NO: 388171 - DNA, 723 bp, Homo sapiens
  misc_feature: GZ8MTXP02J1G5C.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggtcacgcgaccccgaaactcttaatttatgtaggttctttcgtcgtccctgtacggggtttctagtcgtctttcgtcccggtctccgtaaacgttcgtacgggacctaaacgacccggggtccccttcccccgtaggtaaccccagtttaccctcgttaaacgacccttacccgaagggtcccgttaggaacggggtaccggacgggggtaccttacgggtaaacctttaagtttaacgtttcgggacctaacgggtcctttacccggaaagtttaacttaaaccgttggtaaaaacggttccctaaaaagtttcgggggtaaacttcccgtaaacggttacgggtacgttcgggtttacccgggggcgggtaaacgggggtaacccgttaaacgggttcggaccccggtttaccgttacgggtacccacggtaaacccccgg

SEQ ID NO: 388172 - DNA, 581 bp, Homo sapiens
  misc_feature: GZ8MTXP02I2PGA.39.39.D06.1.454.CMB.2.raw
  modified_base (271)..(271): a, c, t, g, unknown or other
tcagtcgcactagtcacgaccggtgctcgatttagtgacatctcgcagttctttgggggggtctcaggaggcagcgctctcaggacatctccaccatggcctggactctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaanagctaattcaggcacgccgaccccgaaaatcttaaatttactgtaggttctttcgtccggccctcgtacggggttttctagttcgctttcgtccggcttccgaagttctggaccaaccgacggccctccctagaccctatctctacgactccaggctggaacggacgagctagtacttattatgcaagtctacatatacagtaagttacaagttggtaactccgtaacgtggccttagggttccggacggtaacgggtaacccgtaaggtttcggaaaccccgttcgtaaacggtccgacggaacccccg

SEQ ID NO: 388173 - DNA, 545 bp, Homo sapiens
  misc_feature: GZ8MTXP02GVSQI.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagccccagggaagggctgagttggattggtgaaataaatgagaccggggcaccgaactacaatgcgtccctcgagggtcgagtcaccatatctgcagacaagtccaagaaccacttctccctgacggctgacccctctgtgaccgcgcggactcggccatatattattgtgcgagtagtttttgacgaggtattcgttggggcggtatcgtacgtcgtggggttacaagggatcgacggtcagtcgtcctcctcacgcctccaccgaacgggcccagtccggtccttcccccgtggcccgccctcgcctccgaaggacgctaccgcgagacgcaccg

SEQ ID NO: 388174 - DNA, 572 bp, Homo sapiens
  misc_feature: GZ8MTXP02FW9MR.39.39.D06.1.454.CMB.2.raw
  modified_base (228)..(228): a, c, t, g, unknown or other
  modified_base (243)..(243): a, c, t, g, unknown or other
  modified_base (253)..(253): a, c, t, g, unknown or other
  modified_base (255)..(255): a, c, t, g, unknown or other
  modified_base (266)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgtacgttgtntacttatatntntctctgtacannctatcagcacgccgaccctaacttcttaattatgtacgttcttcgtcgtcctgtacggttctcgtcgtcttcgtccgtctcgagtcgtagaccacaccgcctcctcacctactctactacgtcctcgacgtctaggaggacgagtctagtaacttattagtcgacgtacgtctactaattactactacgtaacgtacgtaaagttacggtactaccgtacgtcggtacgttacggttaccgggacggaacggtaaccgtaacggttaccggtacccgttaccgtaacggtaccgaacggtacccg

SEQ ID NO: 388175 - DNA, 546 bp, Homo sapiens
  misc_feature: GZ8MTXP02HW9DE.39.39.D06.1.454.CMB.2.raw
  modified_base (243)..(243): a, c, t, g, unknown or other
  modified_base (310)..(310): a, c, t, g, unknown or other
  modified_base (446)..(446): a, c, t, g, unknown or other
  modified_base (453)..(453): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggttccaaacagcattcaggcagccgaccccgaaaatcttaaatttangtaggttctttcgtcggccctgtacggggtttctagtcgtcttcgtccggctcctaagtctggccaaacgaccggcccttcccagacccatcctactacgacctcgaggctagaggacgaggctagactattagtncagctanatactactagaagtacaagtcgtactccacgtcggcgttcggtcggacggaacggtaacgtaacgtcgaccgttcgtacgtaccgacggaccg

SEQ ID NO: 388176 - DNA, 767 bp, Homo sapiens
  misc_feature: GZ8MTXP02GG20I.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgtacggttctttccggtccggtccctcgtacggggtttctagttcgtcctttctccggctccgtaagtctcgggccaaacgtaccgggcccttcccgtacgaccctaacgtccttccgtaacggtacccttcccgaaacggggtccttacggggaacggggaccggtaaggggtaccttacgggtaaaccctttaaggttttaacgtttcggaccgtaaggtacccttaaccgtaaatttaaactttaaaccgttaggtaaaacggtttaccctaaaaggttttacgggtaaaactttaccccgtaaacggtttaccgggtaccgtttcggggttttaacccgggggaccgggggtaaaaccgggggtaaaccccttaaaaacgggggtttccggtaaacccccgggtttaaccccgttaaacgggggtttaccccgaaaaccggtaaaccccccgggg

SEQ ID NO: 388177 - DNA, 624 bp, Homo sapiens
  misc_feature: GZ8MTXP02GDTA8.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcacgccgaccccgaaacttctttaaatttatgtaggttctttacgtccggtccctcgtacggggtttctagtcgtcttcgtccgctccaagtctggcaacgcgcctcctagaccatctactacgacctccagctaggaggacgaggctaggacttacttatgaccagtacctacaattatacgtagtaagtacctaaaagttcggttaacctaccgtaacgttcgggtaccgtttcggggtttaccggggaccggggtaaacggggtaacccgttaaaacgggttccggttaaaccccggtaccggttaaacggggttacccgtaacggtaaaccccccgggg

SEQ ID NO: 388178 - DNA, 543 bp, Homo sapiens
  misc_feature: GZ8MTXP02GYWDQ.39.39.D06.1.454.CMB.2.raw
  modified_base (385)..(385): a, c, t, g, unknown or other
  modified_base (413)..(413): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttaccaacagcattcaggcagccgaccccgaaatcttaatttatgagttctttcgtcggtccctgacggggtttctagtcgcttctccggctccgaagtctggcaacacgcctccctgaccntctctagacctccaggctggacggacgnggctgactattattgctagctacatatactgaagtcaaagttcggtaactccgtaacgtggcttggttaccgggcggtaacgggaaccgtaaaggttcgacccgttacgtacggtaccgacgtaaccccg

SEQ ID NO: 388179 - DNA, 495 bp, Homo sapiens
  misc_feature: GZ8MTXP02H9KRY.39.39.D06.1.454.CMB.2.raw
  modified_base (241)..(241): a, c, t, g, unknown or other
  modified_base (267)..(267): a, c, t, g, unknown or other
  modified_base (340)..(340): a, c, t, g, unknown or other
  modified_base (463)..(463): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccagcagtgacgtggngcttataattatgtctctgttccaangcatcaggcagccgaccccgaaacttcttaaatttatgtagtctttcgtcggtcctgacggggtttctagtcncttctccggctcaagtctggacaacacggcctccctgacccatctctagaccttccgagtctagaggacgagctgaactattatgcagctacatatctagatacaatgattcactgctgtcgnggagaaccgagtcgacgtctacggacagaccg

SEQ ID NO: 388180 - DNA, 523 bp, Homo sapiens
  misc_feature: GZ8MTXP02IJB5N.39.39.D06.1.454.CMB.2.raw
  modified_base (230)..(230): a, c, t, g, unknown or other
  modified_base (271)..(271): a, c, t, g, unknown or other
  modified_base (366)..(366): a, c, t, g, unknown or other
  modified_base (375)..(375): a, c, t, g, unknown or other
  modified_base (381)..(381): a, c, t, g, unknown or other
  modified_base (399)..(399): a, c, t, g, unknown or other
  modified_base (475)..(475): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctcctgcactggaaccngcagtgacgttggtgcttatattatgtctctgttaccaacngctattcaggcagccgaccccgaaatcttaatttatgtagtctttcgcgtcctgtaggggtttctagtcgtcttctccggctccaatctggcacncggcctccnacatcnctagctcagctgacgagngctgtactattattgcagtctctatatacgtgtaagtctaatcggtaactcctaacgttggacttcggttaccggnggtaacggaacgtaaacgtcggtaccgttcgtacggtcacggtacccg

SEQ ID NO: 388181 - DNA, 591 bp, Homo sapiens
  misc_feature: GZ8MTXP02F1KVP.39.39.D06.1.454.CMB.2.raw
  modified_base (227)..(227): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactggaaccngcagtgacgttggtgcttatattatgtctctgttccaacagcattcagcagccgaccccgaaaacttcttaaatttatgtaggttctttcgtcggtccctcgtacggggtttctacgtcgtcttctccggtctccgaagtctggaccaacgacggcctccctcgacctatctctagacctccgagtctacgacggacgaggctagtaacttagttattgactagctacatactacgtagtaagtactaaagttcggtacttaccgacgttggtcgttcggttaccgggacgggtaacgggtaaaccgtaacggtttacggtaaccccggttcccgttaaacgggttccgaaccggtaaccccgg

SEQ ID NO: 388182 - DNA, 527 bp, Homo sapiens
  misc_feature: GZ8MTXP02FF0WL.39.39.D06.1.454.CMB.2.raw
  modified_base (307)..(307): a, c, t, g, unknown or other
  modified_base (347)..(347): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttataatatgtctcctggttccaacagcattcaggcagcgccccgaaactcttaaatttangagttctttcgcggccctgacggggtttctagtcgcttcnccggctccaagtctggcaacacggcctccctgaccatcctctagacctcccaggctggaggacgaggctgactattattgcagcctacattatactagaagttcaaatggtaactccaactggcttcggttccggacggtacgggaaccaagttcgaccgtccgtaaggccagaccccgg

SEQ ID NO: 388183 - DNA, 559 bp, Homo sapiens
  misc_feature: GZ8MTXP02GH305.39.39.D06.1.454.CMB.2.raw
  modified_base (271)..(271): a, c, t, g, unknown or other
  modified_base (447)..(447): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctgttccaanagcatcaggcagcgaccccgaaatcttaatttatgagttctttcgtcgccctcgtacggggtttctagtctcttctccgctccaagtctggcaaccacggccctccctgaccctatctactacgacctccgacggtctaggaggacgaggacctgtaacttagttattcgactacncttacaatactactaggaaatcaaattggtactccacgttggcgttcggttccgggacgggtaagggaacccgtaaaggttcgacccgtaccgtacggtacacggtaacccg

SEQ ID NO: 388184 - DNA, 504 bp, Homo sapiens
  misc_feature: GZ8MTXP02GXIC6.39.39.D06.1.454.CMB.2.raw
  modified_base (430)..(430): a, c, t, g, unknown or other
  modified_base (433)..(433): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaacagcattcaggcagcgaccccgaaactcttaatttatgagttctttcgtcggccctcgacggggtttctagtctcttcgtccggctccaagtctggcaacacggcctccctgaccatctactagacctccagctagaggacgaggctgaactattatgcanctnatatatgaaagtcaaatggtatcaactggctgtcggaggaggaacctaagtcgaccgtctagtcagacccg

SEQ ID NO: 388185 - DNA, 637 bp, Homo sapiens
  misc_feature: GZ8MTXP02JRMCG.39.39.D06.1.454.CMB.2.raw
  modified_base (230)..(230): a, c, t, g, unknown or other
  modified_base (392)..(392): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatctcctgcactggaaccngcagtgacgttggtgcttataattatgtctcctggttccaacagcattcaggcacgccgaccccgaaactcttaactttatgtacggtctttcgtccggtccctgtacggggtttctagtcgtcttctccggctccgagtctggacaacgacggtccctccncgaccatcctacgtacacctccgaggtcctaggacggacgaaggccgttaggtaaccttaagtttagtttacgaccgtacggtaccttaccgtaaatttaacctaactaaggtaaacgtaccgtaaattacggggtactacccgaaacggttcggtaccgtttcgggttaccgggaccggggtaacgggaaccgttaaaggttccggacccggttaccgtacgggttaccgacggaaacccccgg

SEQ ID NO: 388186 - DNA, 553 bp, Homo sapiens
  misc_feature: GZ8MTXP02ISGUX.39.39.D06.1.454.CMB.2.raw
  modified_base (381)..(381): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctggttaccaacagcattcaggcagccgaccccgaaatcttaatttatgtagttctttcgtccgtcctcgtacggggtttctagtcgtcttctccgctccagtctggcaaccgcgcctccngaccatctactagtacctcaggctggacgacgaggctagtacttattattcgcacgtctctaattatactagtaaagtacaagttaggtactccgaacgtcggtacttgggtaccggacggtaacgggtaacctaaaggttcggtaaccgttcgtaacggtccacgtacccg

SEQ ID NO: 388187 - DNA, 601 bp, Homo sapiens
  misc_feature: GZ8MTXP02JAD6V.39.39.D06.1.454.CMB.2.raw
  modified_base (229)..(229): a, c, t, g, unknown or other
  modified_base (271)..(271): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtccctgggcccagtctggcctgacacagcctgcctccgtgtctgagactcctggacagtcgatcaccatctcctgcactggaaccngcagtgacgttggtgcttataattatgtctcctggttccaanagcattcaggcagccgaccccgaaaacttcttaaatttatggtaggttctttcgtccggtccctcgtacggggtttctagtcgtctttcgtccggctccgtaagtcctggaccaacgaccggtccctcccgtacgaccctatcctactacgacctccaggctgacggacgagctgacttattagtgactagctacatatacgtagaaagtctaagtacggtactccgtaacgttcggtcgttacgggttaccggggacggggtaaacggggtaaccgttaaacgggtttcggaaaccccggttcgtaacgggttccaacggtacccccgg

SEQ ID NO: 388188 - DNA, 618 bp, Homo sapiens
  misc_feature: GZ8MTXP02GRP6Q.39.39.D06.1.454.CMB.2.raw
  modified_base (264)..(264): a, c, t, g, unknown or other
  modified_base (336)..(336): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgctatatatgtctctgtcaangcatcagcagcgaccccaaatcttaattatgagttcttcgtcgtcctgtacggggtttctagtcgtcttccnccggctcctaagtctggaccaacgacggtccctccctacgaccctatctactagaccttccaggtctaggacggacgacggtactaggtaacttagttaagttcgactacgtacctctaaacttacttaaccgttaggtaaacgttacgtaaaagttacggttaaacttacccgtaacgtacgggtcgttcggggttaccgggacggggtaacgggaaccgttaaacggttaccggtaaacccggtcccgtttaaacgggtacccgtaacggtaacccccgg

SEQ ID NO: 388189 - DNA, 580 bp, Homo sapiens
  misc_feature: GZ8MTXP02HGWKD.39.39.D06.1.454.CMB.2.raw
  modified_base (303)..(303): a, c, t, g, unknown or other
  modified_base (330)..(330): a, c, t, g, unknown or other
  modified_base (348)..(348): a, c, t, g, unknown or other
  modified_base (384)..(384): a, c, t, g, unknown or other
  modified_base (533)..(533): a, c, t, g, unknown or other
  modified_base (559)..(559): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaagggctgagttggattggtagaaataaagtgaggaccggggcaccaactacaatgcgtccctgaggggtcgagtcaccatanctgcagacaagtccaagacccacttcnccctgaggctgacccctntgtcgaccgcgcggactccggccatactattattgngcgagttagtttttgcgtagggtacttcggttgggggtcggtacgttcggacggttcgtgggggtacgaaggggtactcgtaacgggtcacgttcgtctccgtcacgtcctaccaccgaacgggccctacgtccggtcccttcccccgnggcccgcccgtcgcctccgaaggacnccgacctcgacgacgacacgg

SEQ ID NO: 388190 - DNA, 576 bp, Homo sapiens
  misc_feature: GZ8MTXP02H45PU.39.39.D06.1.454.CMB.2.raw
  modified_base (242)..(242): a, c, t, g, unknown or other
  modified_base (248)..(248): a, c, t, g, unknown or other
  modified_base (254)..(254): a, c, t, g, unknown or other
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaacagcagtgacgttggngcttanaattangtctctggttccaaacgnctatcgagcacgacccgaaccctaaattacttaattgtagtacgttcttccgtccgtcctagtacggttctacgtcgtcttcgtccgtctccgtagtctacgacaaccgtccgtcctccacacctatctactacgcctacgacgtacgtaggacgacgagtactagtaacttattagtgactagtactacgtaataacgtaacgtagtaacgtactaagtcgtactccgacgttcggtacgttacggtacgggacggtaacggtaacgtacgtaccgtaccgtacgtacggtaccgacgtaccg

SEQ ID NO: 388191 - DNA, 557 bp, Homo sapiens
  misc_feature: GZ8MTXP02HP3ZA.39.39.D06.1.454.CMB.2.raw
  modified_base (409)..(409): a, c, t, g, unknown or other
  modified_base (449)..(449): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgaggttcttcgtcggccttcgtacggggtttctagtcgtctttcgtcccggtctcccaagttctaggccaaacgaccggcctccctgaccctatcctctancccttcgagtctggaggacgaggctggacttatttagttnacagctacgatatactgaatactaaagtggtactccactcggcttggttccggagggtacgggaaccgtaagttacggtacccgtacgtacggtcacgtaacccccgg

SEQ ID NO: 388192 - DNA, 542 bp, Homo sapiens
  misc_feature: GZ8MTXP02HEKLZ.39.39.D06.1.454.CMB.2.raw
  modified_base (242)..(242): a, c, t, g, unknown or other
  modified_base (269)..(269): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctgttccaanagcattcaggcagccgaccccgaaaatcttaaatttatgagttctttcgtcgccctgaggggtttcagtcgctttcgtccggctccaagttctgggacctaaaccgacggtccccttccctacgaccctatcctactagaccttccgaggctgaggacgaggctgtactatttatgacagctcaattatactagaagtcaaattggtactccgacgtggacttggttcggacggtaggaacctaagttcgaaccgtcgaacggtcacgacccg

SEQ ID NO: 388193 - DNA, 622 bp, Homo sapiens
  misc_feature: GZ8MTXP02H1UE2.39.39.D06.1.454.CMB.2.raw
  modified_base (242)..(242): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngtcttataattatgtctcctggttaccaacagctattcgaggtcagcccgaccccgaaaacttcttaaatttatgtaggttcctttaccggtccggtccctcgtacggggttttctacgtcgtcctttcgtccggcttccgaagtcttacggcaaaccgtccgccttccctgaaccctatcctactacgaccctccaggctagacggacgaggctaggtacttagttacttgctagctacgtattactagtagtaatactaaagttcggtaacttcccgtaacgttcggtacgtttcgggttaccggggacgggtacggggtaaacccgtaaggttaccggacccggtttaccggaaccggttccgaacggtacccccgg

SEQ ID NO: 388194 - DNA, 616 bp, Homo sapiens
  misc_feature: GZ8MTXP02HQQ4D.39.39.D06.1.454.CMB.2.raw
  modified_base (264)..(264): a, c, t, g, unknown or other
  modified_base (333)..(333): a, c, t, g, unknown or other
  modified_base (342)..(342): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcatggaaccagcagtgacgtgtgcttataattatgtctcctgtccaangcattcaggcagccgaccccgtaaatcttaaatttatgtacgtcttcgtcgcctgacgggttctagtcncttctccgntccaagtctcggacaacgcgcctccctagacctatctactagacctccgaggctaggacggacgacggtactaggtaacttaagtttagttacggactaaacgccttaaacgtaacttaacgtaacgtaagtaaacgtaacgtaaagttacggtaaccttaccgtaaacgttacggtaacggttcgggttaccggggaacgggtaaaccgggtaaccgttaaacggttacccggtaaccccggttacgtaacgggttaccgaaaccggtacccg

SEQ ID NO: 388195 - DNA, 544 bp, Homo sapiens
  misc_feature: GZ8MTXP02GR0CK.39.39.D06.1.454.CMB.2.raw
  modified_base (229)..(229): a, c, t, g, unknown or other
  modified_base (450)..(450): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctcctggttaccaacagctattcaggcacgccgaccccgaaactcttaatttatgtagttcttcgtcggccctgtacggggtttctagtcgtcttcgtccgctccagtctggacaacgacggccctcctcgacctatctactacgacctccgaggctaggacggacgaggcctagacttattatcgcagcctanatatacgtagtaagtacaattaggtactccgacgtcggctcggttcggacggaacggaacctaggtcgtaccgtacgtacggtccacgaccccg

SEQ ID NO: 388196 - DNA, 556 bp, Homo sapiens
  misc_feature: GZ8MTXP02GJYSW.39.39.D06.1.454.CMB.2.raw
  modified_base (271)..(271): a, c, t, g, unknown or other
  modified_base (419)..(419): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctgttccaanagcattcaggcagccgaccccgaaatcttaatttatgtagttctttcgtcgtcctcgtacggggtttctagtcgtcttctccggctccgaagtctggaccaaccaccggcctccctgacctatctctagctccaggctaggaggacgngctagtacttattatgacacgctctatatactaggaaacttcaaagtggtaactcctaacgtcggtcttggttaccgggcgggtaacgggaaccgtaaaggttcggaacccgttcgtaacggttccaacggaccccg

SEQ ID NO: 388197 - DNA, 631 bp, Homo sapiens
  misc_feature: GZ8MTXP02G8RAW.39.39.D06.1.454.CMB.2.raw
  modified_base (229)..(229): a, c, t, g, unknown or other
  modified_base (268)..(268): a, c, t, g, unknown or other
  modified_base (475)..(475): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgtctatattatgtctctgtaccaacngcatcaggcagccgacccgaaactcttaatttatgtacgttcttcgtcgcctgtacggggtttctagtcgtcttcgtccgtctccgaagttctcggaccaaaccgtaccggccctcccgtacgaccacttctactacgacctcgaaggtcctaggaacggacggacggtactacggaacctttaatttaagttcgacaagtccttanaattaactacgtagtaaacgtactaaaagttcggtaaacttccgaaacgtcgggtacgttcgggttaccgggacggggaaaccggggtaaaaccgttaacgggtttaccggaccccggtttaccggtaacgggttacccgaacggtaaacccccgg

SEQ ID NO: 388198 - DNA, 571 bp, Homo sapiens
  misc_feature: GZ8MTXP02JTQQF.39.39.D06.1.454.CMB.2.raw
  modified_base (256)..(256): a, c, t, g, unknown or other
  modified_base (268)..(269): a, c, t, g, unknown or other
  modified_base (273)..(273): a, c, t, g, unknown or other
  modified_base (288)..(288): a, c, t, g, unknown or other
  modified_base (294)..(294): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacggttggtgtcttataattntgtctctgtcanncatnagcagccaccgaatntaattngtagtcttcgtcgcctgtacgggttcagtctcttcgtccgctctacgtctcgtaccaaccgtccggtccctccctacgaccctattcctctacgtaccctaccgaggtctaggaggaccgaggtccgtgtaacttattagttcgacaagtctactaattaactacgtagtaacgtactaagttacggtactcccgagttcggtcgttcgggttaccggacgggtaacggtaaccgtaaggttccgtacccgttacgtaaccggtccgaacgacccgg

SEQ ID NO: 388199 - DNA, 544 bp, Homo sapiens
  misc_feature: GZ8MTXP02F4YB2.39.39.D06.1.454.CMB.2.raw
  modified_base (268)..(268): a, c, t, g, unknown or other
  modified_base (434)..(434): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctgttccaanagcattcaggcagccgaccccgaaaacttcttaaatttatgtaggttcctttcgtccggtcccttcgtacggggtttctagtcgtcttcgtccggctccaagtctggaccaacgacggccctccctgacctactcctactacgacctccgaggtcctagaggacgnggctagacttattattgcagtctacaatataactgaaagtcaaatggtactccacgtggcttcggttcggcggtaggaacaaggttcgaccgtcgtaggcctagacccgg

SEQ ID NO: 388200 - DNA, 523 bp, Homo sapiens
  misc_feature: GZ8MTXP02JSGN3.39.39.D06.1.454.CMB.2.raw
  modified_base (344)..(344): a, c, t, g, unknown or other
  modified_base (365)..(365): a, c, t, g, unknown or other
  modified_base (444)..(444): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcagcagcgaccccgaaatcttaatttatgagttctttcgtcgcctgaggggtttctagtcgtcttcnccggctccaagtctggcaacncggcctccctgacccatctctacgacctcagctgacgacgaggctgactattatgcagctcaatatactaggaacttanaagttacgtactcgtacgtgtacgttcggtcggacggacggtaaccgtaggtacgtaccgtacgtacggtacacgaccg

SEQ ID NO: 388201 - DNA, 654 bp, Homo sapiens
  misc_feature: GZ8MTXP02F9KA3.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctcctgcactggaaccagcagtgacgttggtgcttataatatgtctctgttccaacagcattcaggcacgccgacccccgaaacttactttaaatttatggtaggtttctttccgtccggtcccttcgtacggggttttctagtcgtctttccgtcccggtcctcccgaagttccgtcggaccaaaccgaccggtccctcccgtcgaccctacttctactacgaccttcccgaggtcctacgggaagggaacccgggagggtacccgtacgtaaaccgtttaaagttttaattcggtacaacggtcctaacgtaactttaactaaccgtagtaaagttaccgtaaaagttacggtaacttcctaacgttggtacgttcgttaccgggcggtaacgggaaccttaggtacgtacccgtacgtacggtacgaccgtaacccgg

SEQ ID NO: 388202 - DNA, 561 bp, Homo sapiens
  misc_feature: GZ8MTXP02I150U.39.39.D06.1.454.CMB.2.raw
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctgaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcagccgaccccgaaatcttaatttatgtagttctttcgtcgtccctgtacggggtttctagtctcttcgccggtctccgaagttccgtcggacctaaaccgaccggtccctcccgtacgaccctattcctcttagaccctccaggcctaggacgacgagtctcggaacttattattgactagctacatatactagaagtcaaagttcgtaatcccaagtcggtcttcggttacggcggtaagggtaaccaaggttcgaaccgtctacggtcacgtacccg

SEQ ID NO: 388203 - DNA, 577 bp, Homo sapiens
  misc_feature: GZ8MTXP02IZ3SY.39.39.D06.1.454.CMB.2.raw
  modified_base (229)..(229): a, c, t, g, unknown or other
  modified_base (430)..(430): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttatattatgtctctggttaccaacagcattcaggtcagcccgaccccgaaacttcttaatttatgtaggttctttcgtccggtccctcgtacgggtttctagtcgctttcgtccggctccagtctggaccacgacggcctcctcgacctactctctacgacctcgacggtctaggacggacgnggctagacttatttatcgcacgctacattactactgtaaacgtataacgttgtacttccaacgttcggactttcggtaccggggcggtaaggggtaaccctaagggtttacgaacccggttccgtaacggtaccgtacggaaccccg

SEQ ID NO: 388204 - DNA, 541 bp, Homo sapiens
  misc_feature: GZ8MTXP02FJVK9.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaagggctgagttggattggtgaaataaatgagaccgggggcaccaactacaatgcgtccctcaggggtcgagtcaccatatctgcagacaagtccaaagaaccacttctccctgaggctgacccctctgtgaccgcgcggactcggccatatattattgtgcgagtagtttttgcaggatcgttggggcggtatcgacgtcgtgggggtcaagggatcgacggtcagtcgtctcctcagcctccaccaacgggcccagtcggtccttcccccgtggccgccctcgcctcccgaaggacgccgaccctccgacgacgccaacg

SEQ ID NO: 388205 - DNA, 648 bp, Homo sapiens
  misc_feature: GZ8MTXP02H0CWL.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaattctttaaatttatgtaggttctttcgtccggccctcgtacggggtttctagtcgcttctccggctccaagtctggcaacgcgcctccctgaccatctctagaccttccgaggctggaacggacgaggtacctgtaccttaagtttagttcgacgtacgtccttactaattaactacgttaagaacgttactaaaaggtttcggtaaactttcccgtaaacgtttcggggtaccgtttacgggtttccggggaaccgggggtaaacggggtaacccgttaaaacggggttttccggtaacccccggtttaccggttaaacgggtttacccgtaaacccggggtaacccccgg

SEQ ID NO: 388206 - DNA, 530 bp, Homo sapiens
  misc_feature: GZ8MTXP02HMWZP.39.39.D06.1.454.CMB.2.raw
  modified_base (230)..(230): a, c, t, g, unknown or other
  modified_base (378)..(378): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaacccngcagtgacgttggtgcttataattatgtctcctggttccaacagctattcaggcagccgaccccgaaactcttaatttatgtaggttctttcgtcggccctcgtacggggtttctagtctcttcgtccggctccgaagtctgacaacncgcctccctgaccatctctagacctccgagctggagacgagctagtacttattatgcagtctagattatactagtaaatcaaagtgtactaccactggtctcggtcggacggaggaaccgtagttacgtaccgtcgtacggtcacgtacccg

SEQ ID NO: 388207 - DNA, 585 bp, Homo sapiens
  misc_feature: GZ8MTXP02H5QTU.39.39.D06.1.454.CMB.2.raw
  modified_base (451)..(451): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgtgtgcttataattatgtctctggttaccaacagcattcgaggcagcccgaccccgtaaatcttaatttatgtagttctttcgtccggcctgtacggggttctagtcgtcttctccggctccgaagtctcggacctaacgccggtccctccctcgacccattcctactacgaccttaccgaggcctaggacggacgagctagacttattatcgntagctcaattacactagaatactaaagttcggtactaccgtagtcgggtcttacgggttccgggacgggtaacgggtaacccgtaacggtttaccggaccccggttacgtaccgggttacaaccggtacccccg

SEQ ID NO: 388208 - DNA, 542 bp, Homo sapiens
  misc_feature: GZ8MTXP02F9E66.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaaatttatgtaggttctttcgtcgtccctgtacggggtttctagtcgtcttctccggctccaagtctggccaacgacggcctccctgaccctatctactagacctccgaggctaggacggacgaggtctggtaactatttatgctagctacattagtactagaatacaatcggtactaccgactcggcttcggtacggcggaggaaccgtaaggttcgaccgttcgtacggtcacgacccg

SEQ ID NO: 388209 - DNA, 533 bp, Homo sapiens
  misc_feature: GZ8MTXP02JSW88.39.39.D06.1.454.CMB.2.raw
  modified_base (271)..(271): a, c, t, g, unknown or other
  modified_base (343)..(343): a, c, t, g, unknown or other
  modified_base (353)..(353): a, c, t, g, unknown or other
  modified_base (376)..(376): a, c, t, g, unknown or other
  modified_base (416)..(416): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctcctggttccaacngcattcaggcagccgaccccgaaatcttaatttatgagttctttcgtcgtccctgtacggggtttctagtcncttctccggntccagtctggcacacgcctcctnaccatctctagactcaggctgacggacgaggctagacttnttatgcagctacatatacgtagaagtctaaattcggtaacttcccgagtcggtcttcggttccggacggtacgggaaccctaaggttcgaccgttccgtacggtaccgacgtacccg

SEQ ID NO: 388210 - DNA, 622 bp, Homo sapiens
  misc_feature: GZ8MTXP02IUI44.39.39.D06.1.454.CMB.2.raw
  modified_base (362)..(362): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatgaatggtggagttgggtccgccaggcccccgagggaagggctggagttggattggtagaaataaagtggaggaccgggggcaccaactacaatgcgtcctcgaggggtcgagtacaccatatctgcaagacaagtccaaagaaccctacttctcccctgacgctacgacccctntcgtcgaccgccgcggactcggccaatatacttattgtgcgtagttagtttttgacgaggtattggttgggggccgttagtcggacgttcgtgggggtacaaggggtactacggacggtcagttccgtcctctacgacgtccctacccaaccgaacgggccctaacgttccccggtcccgttcccccgtgggccccgtcccgttcgcccttaccgaacgggacccgtcccgtacccgacccggacgaccgacgaacccgg

SEQ ID NO: 388211 - DNA, 556 bp, Homo sapiens
  misc_feature: GZ8MTXP02IMMSV.39.39.D06.1.454.CMB.2.raw
  modified_base (372)..(372): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaacagcatttcaggcagccgaccccgaaacttcttaaatttatgaggttctttcgtcggccctctacggggtttctagtcgtcttcgtccggctccaagttcnggcaacacggcctccctagaccatctctagactcaggctgacggcgagctgacttatttatgacagctacaatatactagtaaatctaaaattgggtactaccaacttcgggctttagggttccggcgggtaacggggaaccttaaggtcggtaacccgtccttacgggtactacgaaccccgg

SEQ ID NO: 388212 - DNA, 581 bp, Homo sapiens
  misc_feature: GZ8MTXP02GU35O.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaactagcattcaggcacgccgaccccgaaaacttcttaaatttatagtaggttctttcgtccggcccttgtacggggtttctagtcgtcttctccggctccgaagtctcggcaacgacggtcctccctgacctatcctactacgacttccgaggtctagacggacgacggtctagacttagttattcgtacagctctaatattacagtaatctaaagtcgttaactcgacgttggtaccttgggttccggacgggaacgggtaacccgtaaggttaccggtacccgttaccgtacggttaccacggtaaccccg

SEQ ID NO: 388213 - DNA, 654 bp, Homo sapiens
  misc_feature: GZ8MTXP02I53MV.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgttatactatgtctcttggtaccaacatccacccaggaccaaacgtaccccaaatgatgtatttatgagtcaacgtaaacgccctagtacgggttcctatcgcttctctgctcagtctgcaacgacgtcctccctacgacctatctcgtcgggccctccgacggcgtacggaacgggaccgacgggtccttaccgttacctttaagtttacgtttcgaccgtaacgtccttactaacttaacttaacaaacgtactaactttaacttaccgttacggttttacgggggtttcgggttacggggttacggggtaaccgggggtaccccgtacccggttacgggtaacccgtttaccggtttaacgggtaccgaaccggtacccccggtaaagggtccccgtttacccccggg

SEQ ID NO: 388214 - DNA, 564 bp, Homo sapiens
  misc_feature: GZ8MTXP02JUK2M.39.39.D06.1.454.CMB.2.raw
  modified_base (327)..(327): a, c, t, g, unknown or other
  modified_base (342)..(342): a, c, t, g, unknown or other
  modified_base (347)..(347): a, c, t, g, unknown or other
  modified_base (352)..(352): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaaatcttaaatttatgagttctttcgtcgccctnacggggtttcagtcncttcnccggntccaagtctaggacaacgacggcctcccgtagaccctaatctactacgaaccttccaggctagagacgacggctagacttattattgcgagctacatatactagaacgtcaaagttcggtaactccgtacgtggacgttcgttacgggacgggtaacgggtaaccgtaaacggttcgaaccggttcctaaacggttccgaacgtaaccccgg

SEQ ID NO: 388215 - DNA, 631 bp, Homo sapiens
  misc_feature: GZ8MTXP02JKB8I.39.39.D06.1.454.CMB.2.raw
  modified_base (504)..(504): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaacagctattcaggcacgccgaccccgtaaaacttcttaaatttatggtaggttctttccgtccggtccctcgtacggggtttctagtcgtcttcgtccgtctccgtaagtctggaccaacgtaccggccctccctacgaccctattcctactacgaccctccgaggctaggaacgggacgaggctaggtaacttattagttgccgtatcctactaattaactactaggtaaacgtnaaaacgttcggtaactcccgtaacgtcggtcgtttacggggttaccggggacgggtaacggggtaaccgtaacgggttaccggtaaccccggttaccgtaacggttacccgaaccggtaaccccggg

SEQ ID NO: 388216 - DNA, 579 bp, Homo sapiens
  misc_feature: GZ8MTXP02GII2D.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcctaccccgaaacttcttaaatttatgtaggttctttcgtccggtccctcgtacggggtttctagtcgtctttctccggtctccgaagtctggaccaaaccgacggtccctccctgaccctatcctactagacctccaggctaggaggacgagctagactattatgcagctacatatactagaagtcaaagttcggtactcctaacgtggcttcggttaccgggacggggtaacgggaacccgttaaggttacggtaacccggttaccgtaacggtaccgtaacggtaaccccgg

SEQ ID NO: 388217 - DNA, 559 bp, Homo sapiens
  misc_feature: GZ8MTXP02FUF9A.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggttctttcgtcgccctcacggggtttctagtcgcttctccggcttccaagtctggcaacacggcctccctgaccatctctagactccaggttgaggacgaggctgactattattgcagctcatatactgaaagtctaaagtggtaactaccaacgttcggcttggtttccgggacggggacggggtaaacccgaaaggtttacggtaacccggttacccgtaggttaccaacggtaccccgaaaccgggg

SEQ ID NO: 388218 - DNA, 584 bp, Homo sapiens
  misc_feature: GZ8MTXP02I9M4O.39.39.D06.1.454.CMB.2.raw
  modified_base (271)..(271): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcacgccgaccccgaaactctttaaatttacgtcggggttctttcggtccggtcccctcggtaggggtttccctagttccgtctttcgtccggcttccagtctaggccaacgaccggccctccctgacctactcctactacgacttccgaggctaggacggacgaggctagacttattattgactagctacattactactagaagtacaagtcggtactaccgtagtcggtcgttcggttccgggaccggtacggaaccgtaaggttccgtaacccggtcgtaacggtccacggacccgtaacgg

SEQ ID NO: 388219 - DNA, 654 bp, Homo sapiens
  misc_feature: GZ8MTXP02F4FOQ.39.39.D06.1.454.CMB.2.raw
  modified_base (272)..(273): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctcctgcactggaaccagcagtgacgttggtgtcttataattatgtcctctgtaccaannctatcagcagccgaccccgtaatcttaatttagtgtacggtttcttcggtccgtccgtgtacgggtttctacgtctctttaccgtcccggcttccgaagttcgtcggacccaaccgaccggtcccctcccgtacgaccctattcctacgtacgtacctacccgaggtcgtacggaacgggacgaggtacccttaggtaaacctttagtttacgtacgggtccctaagtcccttactaaagttacttaaaccgtagtaaaacgttcgtaaaagttcggtacctaccgtaccgtgggttcttacggggttacggggacgggtaacggtaaccgttaacggttacccgtaacccggttccgttaacggaccgaccggaaccccg

SEQ ID NO: 388220 - DNA, 692 bp, Homo sapiens
  misc_feature: GZ8MTXP02IRDV4.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcacgccgaccccgtaaaatcttaaatttatgtagttctttcgtccggccctcgtacggggtttctagtccgtctttccgtcccggtctccgtaaagttccgtcgggacctaaaccgaccggtccccttcccgtacgaaccctacttccctaccgtacgtacccttcccgaagggtcctacggaaacgggaccgaacgggtccgttaggtaaacctttaattttacgttcggaccgtaacgtccttacctaaattaacgttacgttaaggtaaacgttactaaaagttacggttaacttacccgtaaacgttcgggtctttacggggttaccgggaccggggtaaacggtaacccgttaaggttaccggtaacccggttaccggtacggttacccgaaccggtaacccccgg

SEQ ID NO: 388221 - DNA, 565 bp, Homo sapiens
  misc_feature: GZ8MTXP02GSIMJ.39.39.D06.1.454.CMB.2.raw
  modified_base (243)..(243): a, c, t, g, unknown or other
  modified_base (455)..(455): a, c, t, g, unknown or other
  modified_base (475)..(475): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtncttataatatgtctctgtccaacagcatcagcacgcgaccccgaaatcttaaatttatgtaggttcttcgtccggtcctcgtacggggtttctacgtcgtcttcgtccggctccgaagtctggaccaacgacggtccctcccgtagaccattcctactacgacctccgaggtcctaggaacggacgaggctgacttattatgacagtcctanaattactacgtagtaaagtnaaaagttggtaaactcccgaagtcggtacttcgggttccggacgggtaagggaaccctaaggttcgaaccgtcgtaacggccacgacccg

SEQ ID NO: 388222 - DNA, 521 bp, Homo sapiens
  misc_feature: GZ8MTXP02JE13B.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaaactcttaatttatgtagtctttcgtcggccctcgacggggtttctagtcgtcttctccggctccgaagtctggcaacacggcctccctgacccatctctagacctcaggtctagaggacgaggtctgactattatgcagctacatatactgaatcaaagttcggtactccagtggctcggttcggcggaaggaaccaaggttcgaccgtacgtacggtcacgtcccg

SEQ ID NO: 388223 - DNA, 522 bp, Homo sapiens
  misc_feature: GZ8MTXP02I1I8O.39.39.D06.1.454.CMB.2.raw
  modified_base (266)..(266): a, c, t, g, unknown or other
  modified_base (369)..(369): a, c, t, g, unknown or other
  modified_base (435)..(435): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttgtgcttatattatgtctctgttccaangcattcagcagcgaccccgaaatcttaatttatgtaggttctttcgtccggtccctcgtacggggtttctagtcgctttctcccggctccaagtctggcaacncggcctccctgacctatctctagacctcaggctgaggacgaggctgacttattattgactagcctnatatactgtaaagtcaaattggtactccacgttggcttggttcggacggaggaacgtaagttcgaccgtcgtacggtcacgtacccg

SEQ ID NO: 388224 - DNA, 589 bp, Homo sapiens
  misc_feature: GZ8MTXP02HGZKW.39.39.D06.1.454.CMB.2.raw
  modified_base (229)..(229): a, c, t, g, unknown or other
  modified_base (270)..(270): a, c, t, g, unknown or other
  modified_base (310)..(310): a, c, t, g, unknown or other
tcagtcgcactagtcacgaccggtgctcgatttagtgacatctcgcagttctttggggggggtctcaggaggcagcgctctcaggacatctccaccatggcatgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctgttaccaanagcattcaggcagccgaccccgtaaaacttcttaaatttntgtaggttctttcgtccggtcctccgtaggggtttctagtcgtcttctccggctcctaagtctggaccaaccgacggccctccctgaccctatccgtctacgactccgaggtctggacggacgaggcttagacgttattacttggacagtctactaattaagtactagtaaaacgtctaaagtacggttactacccgtagtcggtcgttacgggttccggacggggtaacggtaacgtaacggttccggtaccggttaccgtaacggtaccgaacccgg

SEQ ID NO: 388225 - DNA, 589 bp, Homo sapiens
  misc_feature: GZ8MTXP02G4CI0.39.39.D06.1.454.CMB.2.raw
  modified_base (461)..(461): a, c, t, g, unknown or other
  modified_base (466)..(466): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctgttaccaacagcattcaggcagccgaccccgtaaacttacttaatttatgtaggttcctttcgtcgtccctcgtacggggtttctagtcgtcttccgtccggctcctaagtctcggacaaccgacggccctccctacgaccctatcctactagacccttacgacggctaggacggacgaggctgtacttattatgcancctanatatactagaagtacaaagtggtaactccgtaacgttggacgtttcgggttaccgggacgggtaacgggtaacccgtaaaaggttcggtacccgttaccgtacggtaccgtaacgaaccccgg

SEQ ID NO: 388226 - DNA, 571 bp, Homo sapiens
  misc_feature: GZ8MTXP02IKQ73.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggccccagtctggcctgacacagcctgcctccgtgtctgagactcctggacagtcgatcaccatctcctgcactggaaccagcagtgacgttggtgcttataattatgtctcctggttaccaacagcattcaggcagcccgacccccgtaaaattctttaaatttatggtaggttccttttcgtccggtcccttcgtacggggtttctagtcgtcttcgtccggctccgaagtctggaccaaccgacggcctccctgaccacttctctagacctccgaggctgaggacgaggctagaacttattatgcagctacattatactgtaagtcaaagttcggtaactccgaacgttggcttcggttaccgggcggtaacgggaaccgtaaggttcggacccgttacgtacggtccaacggtaccccg

SEQ ID NO: 388227 - DNA, 524 bp, Homo sapiens
  misc_feature: GZ8MTXP02JZH1X.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgtggtgcttataattatgtctcctggttccaacagcattcaggcagccgaccccgaaaactcttaaatttatgtaggttctttcgtccggtccctcgtacggggtttctagtcgtcttctccggctccgaagtctaggaccaacacggtccctccctcgacccatcctctagacctcgaggctaggaggaccgaggctgtacttattattgcagtctcatatacaagcagcagcactcttagtgtactcgggagagggaacctaagctcgaccgtcgtaggtcaacg

SEQ ID NO: 388228 - DNA, 607 bp, Homo sapiens
  misc_feature: GZ8MTXP02FQO9G.39.39.D06.1.454.CMB.2.raw
  modified_base (243)..(243): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtncttatattatgtctctgttccaanagcatcaggcacgccgaccccgaaacttcttaatttatggtaggttctttcgtccggtccctcgtacggggtttctacgtcgtctttccgtccggctccgaagttcgtaggaccaaaccgacggtccctccctagaccctatctacgtagacctccgaggtctagacggacgagctagtaacttattatgcagtctactaattatacgtagtaaacgtctaaaagtcggttactaccgtacgttggtaccgttgggttaccggggacggtaaacggggtaaccgtaaaacgggtttcggaaccccggttccgtaaacggggtcccaaacggtaaccccgg

SEQ ID NO: 388229 - DNA, 578 bp, Homo sapiens
  misc_feature: GZ8MTXP02FPTAT.39.39.D06.1.454.CMB.2.raw
  modified_base (242)..(242): a, c, t, g, unknown or other
  modified_base (449)..(449): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactggaaccagcagtgacgttggtncttataattatgtctcctggttccaacagcattcagcagcgaccccgaaatcttaatttatgtagttctttcgtcgacctcgtacggggtttctagtcgtcttctccggctcaagtctaggacctaacgacggtcctccctgacctatctactagcttaccaggtcacgacggacgacggtctacgaacttagttattcggactaancctaatattatacgttaggaatacaattcggtaactccgtacgtggtcttacgggttacggcgggtaaacgggtaacccgtaaaggtttcggaacccggttaccgttaaggtcccgaacgtaaccccgg

SEQ ID NO: 388230 - DNA, 569 bp, Homo sapiens
  misc_feature: GZ8MTXP02FHW0G.39.39.D06.1.454.CMB.2.raw
  modified_base (228)..(228): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgacgttggtgcttataattatgtctcctggttccaacagcattcaggcagccgaccccgaaaacttctttaaatttatgtaggttctttcgtcggtccctcgtacggggtttctagtcgtcttctccggctccaagtctggcaacacggcctccctcgaccatctactacgacctccgaggtctaggacggacgaggctagaacttattattgacagcctacatactacgtagaagtcaagtcggtactccgtaacgtcggtcttcggttaccgggacgggtaacgggaaccgtaaggtttacgacccggttaccgtacggtccacggtaaccccg

SEQ ID NO: 388231 - DNA, 557 bp, Homo sapiens
  misc_feature: GZ8MTXP02G0GA6.39.39.D06.1.454.CMB.2.raw
  modified_base (329)..(329): a, c, t, g, unknown or other
  modified_base (343)..(343): a, c, t, g, unknown or other
  modified_base (374)..(374): a, c, t, g, unknown or other
  modified_base (543)..(543): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagccccagggaagggctgagttggattggtagaaataagtgaggaccggggcaccgaactacaatgcgtccctgaggggtcagtcaccatatctgcagacaagtcaagacccactctcccngagctcgacccctntgtcgaccgccgcgactcggcctatatattntgtgcgtagtagttttgctaggattcggttggggcggttagtcggtacgttcgtggggtacaagggtactcgacggtcagtcgtcgtcctcgacgtcctccaccgacgggccccacgttccggtccttcccccgtggcccgtcccgtcgcctaccgcggacgcctaccnccgacgcgacaccg

SEQ ID NO: 388232 - DNA, 544 bp, Homo sapiens
  misc_feature: GZ8MTXP02F9P8O.39.39.D06.1.454.CMB.2.raw
  modified_base (229)..(229): a, c, t, g, unknown or other
  modified_base (416)..(416): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctgttccaacagcattcagcagcgccccgaaaactcttaatttatgaggttctttcgtcgccctcgacggggtttctagtcgtcttctccggctccaagtctggccaacacggccctccctgacccatcctctagacctccaggctaggaggacgnggctagaacttattattgcagctcatatactagaaagtcaaaatggtactcctacgtggtcttgttccgggcggaacggggaacctaacggttacgacccggttcctaaaggtccaaggtaaccccgg

SEQ ID NO: 388233 - DNA, 555 bp, Homo sapiens
  misc_feature: GZ8MTXP02HLIN7.39.39.D06.1.454.CMB.2.raw
  modified_base (268)..(268): a, c, t, g, unknown or other
  modified_base (276)..(276): a, c, t, g, unknown or other
  modified_base (340)..(340): a, c, t, g, unknown or other
  modified_base (352)..(352): a, c, t, g, unknown or other
  modified_base (359)..(359): a, c, t, g, unknown or other
  modified_base (369)..(369): a, c, t, g, unknown or other
  modified_base (423)..(423): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccagcagtgacgttggtgtacttataattatgtctctgtcaangcatcagnagccgacccctaaatcttaatttatgtagttcttcgtcgcctgtcgggtttctagtcgtcttcnccgctccagtcngaccacnccgcctcccngaccatctcagctcgagctgacggtacgagtctagaacttattattgacgtacnctactaataattaactaggtaatacgaaacgttggtaacttaccgaacgttcggtacttcgggttacggacgggtaacgggtaacctaaggttaccgtaaccgtaccgtacggtaccgaaccggtaaccccg

SEQ ID NO: 388234 - DNA, 520 bp, Homo sapiens
  misc_feature: GZ8MTXP02JH4E1.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaactcttaaatttatgagttctttcgtcggccctcgtacggggtttctagtcgtcttctccggctccaagtctgacacacggcctccctgaccatctctacgactccacggctgacggacgaggctgacttattattgcagctcattatactgaagtcaatggtactcactggcttggttcggcggaggaaccgaaggttcgaccgtcgtacggtacgacgtacccg

SEQ ID NO: 388235 - DNA, 548 bp, Homo sapiens
  misc_feature: GZ8MTXP02FUS68.39.39.D06.1.454.CMB.2.raw
  modified_base (422)..(422): a, c, t, g, unknown or other
  modified_base (452)..(452): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttaataatatgtctcctggttaccaacagcattcaggcagcgaccccgaaaattcttaaatttatgtagttctttcgtcggccctcgtacggggtttctagtcgtctttcgtcccggcttcccaagttctgggaccaaacacggccctccctgacctatctactagactccaggtcngaggacgaggctagacttaattatgacacnctacatactactagtaatacaaagtcgtactactacgtgtacgtcggtacggacggaacggaactaaggttacgacgtacgtacggccacgtaccg

SEQ ID NO: 388236 - DNA, 549 bp, Homo sapiens
  misc_feature: GZ8MTXP02GD2V4.39.39.D06.1.454.CMB.2.raw
  modified_base (229)..(229): a, c, t, g, unknown or other
  modified_base (450)..(450): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatgtctcctgttccaacagcattcaggcagccgccccgaaaactcttaaatttatgtagttctttcgtccggtcccctcgtacggggtttctagtcgtcttctcccggtctcctaagtctggaccaacgacggccctccctgacctactctctagacctccaggtctggacgacgagctagacttattatgcagcctntatatactgaaagtcaaagtcggtactccgactggtcttcggttccggacggaacgggaaccgtaaggttcgacccgtcgttaacggccacgaccccgg

SEQ ID NO: 388237 - DNA, 697 bp, Homo sapiens
  misc_feature: GZ8MTXP02FRB5X.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccagcagtgacgttggtgtcttataattatgtctcctgttccaacagcattcaggcacgccgacccccgtaaaactctttaaatttagtaggtacggtttctttccggtcggtccccttacggtaaccggggttttctacggtccgtcctttcccgtcccgggtacttaccccgaaagttcccgttacgggaccctaaacccgtacccgggtcccccttcccgttacgacccctaacttccttaccgtaacgacccttcccgaggtccgtaggaacggggacgagggtctacggaactttagttacttgactagtcctactataattacgagtaaaacgtcaaaagttcggttaaactcccgtaagttcgggtacttcgggggttaccgggacggggtaaacgggtaaccccgttaaaggtttacccggaaacccggttcccgtttaaagggtcccaacggggtaacccccg

SEQ ID NO: 388238 - DNA, 545 bp, Homo sapiens
  misc_feature: GZ8MTXP02F2UAR.39.39.D06.1.454.CMB.2.raw
  modified_base (228)..(228): a, c, t, g, unknown or other
  modified_base (264)..(264): a, c, t, g, unknown or other
  modified_base (271)..(271): a, c, t, g, unknown or other
  modified_base (296)..(296): a, c, t, g, unknown or other
  modified_base (327)..(327): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccngcagtgacgttggtgtcttatatatgtctctgtcanagctatnagcagccgacccgaatcttaattangtagttcttcgtcgcctgtaggttctagtcncttctccgctcagtctgactacacggccctcctgacctatctactagcctccgaggtctaggaggacgcggtctagtaacttattagtcgacagtcctctaattatacgtagtaagtacaaagttcgtactccctagttcggtcgttacgggttcgggacgggtaacgggtaaccgtaaacggttcgtacccggtacgttaacggccacggtaacccg

SEQ ID NO: 388239 - DNA, 688 bp, Homo sapiens
  misc_feature: GZ8MTXP02HP3N1.39.39.D06.1.454.CMB.2.raw
  modified_base (200)..(200): a, c, t, g, unknown or other
  modified_base (228)..(228): a, c, t, g, unknown or other
  modified_base (274)..(274): a, c, t, g, unknown or other
  modified_base (311)..(311): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacngtcgatccacatctctgcactggaaccngcagtgacgttggtgtcttaataattatgtctcctggttaccaacngcattcaggcacgccgaccccgtaaattcttaatttntgtagttcttcgtccgcctgtacgggtttcagtcgtcgttcgtcccggtctccgtaagtcgtacggaccaaccgacccggtccctcccgtagtaccctactttcctaccgtacgaacccgttcccgaggtcgtacggacgggacggacgtcgttaggtacctttaagtttacgtcgacgtacgtcgttactaacttaagttaacgtaggtaaacgttaccgtaaaggtttacgggttacccttacccgtaacggtttaccgggtaccgggttttcggggtaccgggggtaaccggggtaaccggggttaaacccgttaaagggttcccggttaaacccggttcccgttaaaacggggtcccaaacgggtaaccccgg

SEQ ID NO: 388240 - DNA, 574 bp, Homo sapiens
  misc_feature: GZ8MTXP02JK2PB.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccagcagtgacgttggtgcttataattatgtctcctggttccaacagcattcaggcagccgaccccgaaactcttaattatgtagttctttcgtcgcctcgtacggggtttctagtctcttctccggtctcaagtctggacaacgacggccctccctacgaccctactcctactacgaaccctccgaggctggaggacgaggcctagacttattagttcgacagtctacatactactagtaagtacaagttcggtaactccaacgtcggtcttcgggttaccgggcgggtaacgggaaccgtaaggttaccggacccggttaccgtacggttaccgacgaaccccgg

SEQ ID NO: 388241 - DNA, 612 bp, Homo sapiens
  misc_feature: GZ8MTXP02GN2BX.39.39.D06.1.454.CMB.2.raw
  modified_base (276)..(276): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatcctcctgcactggaaccagcagtgacgttggtgtcttaataattatgtctcctggttaccaanagctattcaggtcacggccgaccccgtaaaatttctttaaatttatggtagttcctttcgcgtcccttgtacggggtttcagtctcttcgtccgctccgagtctgaccaacgaccggtccctccctagacctactctactacgaccctccgaggtctaggaaggacgaggtacttacgtaacttatttatcggactagtaccctataattactaactagaacgttacaaagttcggttaaactccgtaacgtcggtcgttacgggttaccggggacggaacgggtaacctaaacggttcgtacccggttacgtacggttccgaacggtaaccccgg

SEQ ID NO: 388242 - DNA, 579 bp, Homo sapiens
  misc_feature: GZ8MTXP02F5518.39.39.D06.1.454.CMB.2.raw
  modified_base (382)..(382): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccacgcccccgagggaagggctgagttggattggtagaaataagtggaggaccgggggcaccaactacaatgcgtccctcgagggtcaggtcaccatatctgcagacaagtccaagacccactctccctgacgctgaccctctgtcgaccgcgcggactcggccatatattattgncgtagtagtttttgcgtaggtattcgttagggggcgttagtcggtacgttcgtagggggtacaaaggggtactcggacggtcacgttcgtccgtcctcgacgtccctaccaccgaacggtcccacgttccggtccctcccccgtggaccctcccgtagccctccgaagcgaccaccgtccgagtaccgacaacccgg

SEQ ID NO: 388243 - DNA, 587 bp, Homo sapiens
  misc_feature: GZ8MTXP02GPLO9.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaacttcttaaatttatgtaggttctttcgtccggcccctgtacggggtttctagtcgtctttcgtccggtctccaagtctcggaccaaccacggtccctcccgtagacctactctctacgacctccgaggtcctaggacggacgaggtctagacttatttatgcagtctactattataactagtaagtacaaagttacggtactacctacgtggtccttgggttacggacgggtaagggtaacccgtaaaggttacgtacccggttactacgggtacccaacggtaaccccgg

SEQ ID NO: 388244 - DNA, 753 bp, Homo sapiens
  misc_feature: GZ8MTXP02FSXOF.39.39.D06.1.454.CMB.2.raw
  modified_base (229)..(229): a, c, t, g, unknown or other
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacngctattcaggcacgaccgaccccgtaaaacttcttaaatttatggtacggttcctttccggtccggtccccttaggtaccgggggttttctacggttccggtcctttccgtcccgggtacttcccgaaagttccgtagggacccaaaccgtaccgggtccccttccctacgtaaccctaacttccctacgttaacgtacccgttacccgaggtaccgtacgggaacgggaaccggtaacgggtccttaacgggtaaacctttagtttaaacgttcggtaccgaaggtcccttaccgtaattaacttaccgtagggtaaacgttacctaaacggttaggttaaaacttcccgtaaacggtacgggttaccgttacggggtttccggggaaccgggttaaccggggtaaaccgttaaaacgggtttccggtaaccccggtttacccgttaacgggggttaccctaaccgggtaaacccccggg

SEQ ID NO: 388245 - DNA, 696 bp, Homo sapiens
  misc_feature: GZ8MTXP02IQ9OY.39.39.D06.1.454.CMB.2.raw
  modified_base (230)..(230): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgtacgttggtgtacttataattatgtcctccgtcggttacccaacagctatttcgaggccacgacccgaacccccgtaaaattacctttaaatttacgtggttacggtttccgtttccggtcccggtcccgttacggttacggggttttcctacggtccgttccgtttccgtcccggtccttaccgtaacggtcgttacgggacctaaaccgcccggtacccctacccgtaccgtaaccctaacttcccgtacgtaccgtacccgtaccgacggtcgttacgggaacggaccggacggtccgtacgtaactttatttactcgacgtaacgtctactaattacgtactaggtaaactacgtaagttacggtaactccgtacgtcggtcgttcgggttaccgggacgggtaacggtaacgtaacggttccgtaccgtacgtacggtacgaccggtaaccccgg

SEQ ID NO: 388246 - DNA, 571 bp, Homo sapiens
  misc_feature: GZ8MTXP02FJRT1.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaagggctgagttggattggtagaaataaatggaggaccgggggcaccaactacaatgcgtccctcgaggggtcgagtcaccatatctgcagacaagtccaaagaaccactctccctgagctgacccctctgtgaccgcgcggactccggcatatattattgtgcgtagtagtttttgcgtaggattcgttgggggcggttatcggacgttcgtggggtacgaagggatcgacggtcagtcgtcctcctcacgccctaccaccgacgggccctacgtcccggtccttcccccgtcggcccgtcccgcgtcctccgaacggacacccgacccgtccgacgacgaccgaaccgg

SEQ ID NO: 388247 - DNA, 736 bp, Homo sapiens
  misc_feature: GZ8MTXP02GAFWR.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcacgccgaccccgaaacttctttaaatttatgtacggttctttcgtccggccctcgtacggggtttctagtcgtcttctccggctccaagtctggacaaccgacggtccctccctcgaccctattccgtactacgtacccttcccgaggtcctagggaacgggtaacgacgggtactacggtaaaccttaagttttaacgtttcgaccgtaagtacccttacgtaaactttaacttaaaccgttaaggtaaaacggtttacctaaaaaggttttacggggttaaacctttaccccgaaacggtttcgggtaacccgtttttcgggggtttaccccgggggaccgggggtaaaaccgggggtaaaaccccgttaaaacgggggttttacccggtaaacccccggtttacccggtttaaaacggggtaccccgttaaacggggtaaacccccccggg

SEQ ID NO: 388248 - DNA, 524 bp, Homo sapiens
  misc_feature: GZ8MTXP02J198Q.39.39.D06.1.454.CMB.2.raw
  modified_base (434)..(434): a, c, t, g, unknown or other
  modified_base (487)..(487): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacaatctcctgcactggaaccagcagtgacgttggtgcttataagttatgtctcctggttccaacagcattcaggcagccgaccccgtaaaactctttaaactttatgtacgttctttcgtcgccctgtacggggtttctagtcgtcttcgccggctccgaagtctggacacgacgtcctaccctgaccatctctagacctccgagctgacgacgagctagactatntcgctagctcaatacttacagaatcaaagtcggtaatccagtgcgtgtccggngacggtaacaaggttcgacgtcgtacgacacgacccg

SEQ ID NO: 388249 - DNA, 636 bp, Homo sapiens
  misc_feature: GZ8MTXP02G6N1A.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataattatgtctctgttaccaactgctattcaggcacgccgaccccgaaattcttaaatttatgtagttctttcgtccgtccctgtacggggtttctacgtcgtcttcgtaccggtctccgaagtcgtacgacctaaccgaccggtccctacccgtacgaccctacgttacctactacgaacccttccgacggaccgtaggaacggacggaggtcctagtaacttaatttacgtcgactaacgtcttacctaaattactaacgtagtaaacgtaccgtaaaagttcggttaactacccgtacgttcggtaccgttcgggttaccggggacgggaacggtaaccgttaacggttcggaacccgttacgtaacggtccaacggtaccccg

SEQ ID NO: 388250 - DNA, 635 bp, Homo sapiens
  misc_feature: GZ8MTXP02H0G9S.39.39.D06.1.454.CMB.2.raw
  modified_base (241)..(241): a, c, t, g, unknown or other
  modified_base (251)..(251): a, c, t, g, unknown or other
  modified_base (305)..(305): a, c, t, g, unknown or other
  modified_base (484)..(484): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactctggacagtcgatcaccatcctcctgcactggaaccagcagtgacgttgncttataattntgtctctgtccaacagctatcaggcagcccgacccgtaaattcttaaatttagngtacgtctttcgccggcccttagtacggggtttctacgtcgctttcgtcccggctcccgtaaagttcctacgggcctaaaccgtccggtccccttccctcgaaccctactcctactacgtacctacccgaggctaggacgggacgaggacgtgtaacttagtttagttgcctagcctanaattatacgttagtaaacgtactaaagttggtaacttccccgtaacgttgggtactttcggggtttaccgggacggggtaacggggtaacccgttaagggttacccggtaaccccggttcgtaaacgggttaccgtaaccgtaaccccggg

SEQ ID NO: 388251 - DNA, 681 bp, Homo sapiens
  misc_feature: GZ8MTXP02I3KE7.39.39.D06.1.454.CMB.2.raw
  modified_base (566)..(566): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctccttggttaccaacagcctattcgaggcacgacccgaccccgtaaaacttacgtttaaaactttagtacggtaacggtttcctttccggtcccggtccccttcggtaaccggggggttttcctaacggttccgtccttttcccgtacccggggtccttaccccgtaaaggttccgttacggggaccaaaacccgtacccgggccccttccctaccgaccctaactccctactacgacctaccgaggctaggacggacgaggctcgaattacttattgactagcttacaattatactagtaacgtanaagttggtactacccgtaacgttcggtacgtttcgggttaccggacgggtaacgggtaaccgtaaacggttacggtacccggtaccgtaacgggtaccgaacccggtaaccccgg

SEQ ID NO: 388252 - DNA, 596 bp, Homo sapiens
  misc_feature: GZ8MTXP02HPY11.39.39.D06.1.454.CMB.2.raw
  modified_base (229)..(229): a, c, t, g, unknown or other
  modified_base (244)..(244): a, c, t, g, unknown or other
  modified_base (246)..(246): a, c, t, g, unknown or other
  modified_base (255)..(255): a, c, t, g, unknown or other
  modified_base (270)..(271): a, c, t, g, unknown or other
  modified_base (301)..(301): a, c, t, g, unknown or other
  modified_base (372)..(372): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgacgactcctggacagtcgatcaccatctctgcactggaacngcagtgtacgttgtntnttataattntgtctctgtaccaanncatcaggcagccgaccctaattcttaattngtagtcttcgtcgcctagtcggtttctagtcgtcttcgtcgctcgtagtctcgaccaacgccgcctacccngacctatcctacgtacgccttcgacggctaggaacggtacgagtctagtaactttagtttagtcgacagtcctaataacgttacttaaaccgtaggtaaagtacctaaaaggtttcggaaaccttcccgaagttcgggtcgttaacggggtccgggaacgggaaaccggtaacgttacggttaccggtacccgtaccggttacggtaccgtaaccggtaccccg

SEQ ID NO: 388253 - DNA, 575 bp, Homo sapiens
  misc_feature: GZ8MTXP02HB3V8.39.39.D06.1.454.CMB.2.raw
  modified_base (342)..(342): a, c, t, g, unknown or other
  modified_base (461)..(461): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccacgcccccaggggaagggctggagttggattggtagaaataaagtggaaggacccgggggacaaccgaaactacaaatgacgtccctcgagggtcagtcaccgatatctgcagacaagtccaagaaccacttcnccctagacgctacgaccctctagtcgaccgtccgacggactccgggaccatagtacttagttgtgcgtagtagtttttgctaggattcgttggggcgttagtcgtacgtcgtggggtanaaggggatcgtacggtctagtccgtactccgtcagccctaccacgaacgggcccagtccgtccttccccgggcccgcctcgcctcgaacgcgccaccgtccgagaccgacaccg

SEQ ID NO: 388254 - DNA, 582 bp, Homo sapiens
  misc_feature: GZ8MTXP02F49GN.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccacatctcctgcactggaaccngcagtgacgttggtgcttataattatgtctctgttccaacagcattcaggcagccgccccgaaaatcttaatttatgaggttctttcgtcgccctcgtacggggtttctagtcgctttcgtccggctccaagtctggaccaacacggccctccctcgacctatctctagacctacaggctagaggacgagcgtacgacttatttattgacagtctactataatactgtaaagtacgtaaatcggttactaccgtaacgtaggtccgttggtttacggggcgggaaacggggtaacccgtaaaggtttacggtaacccggttacccgttaacggtaccgtaacggtaaaccccgg

SEQ ID NO: 388255 - DNA, 742 bp, Homo sapiens
  misc_feature: GZ8MTXP02FUX4S.39.39.D06.1.454.CMB.2.raw
  modified_base (327)..(327): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatccaccatcctcctgcactggaaccagcagtgacggttggtgtacttaataattatgttcctccgttggttaccaacagactattcgaggcaggcccgacccccgtaaattcttaaatttnggtaggttctttcgcggtcccttggtacggggtttcctaggtccgtcctttaccgtccggtccttaccgtaaggttcctagggacccaaccgtacccgggtccccttaccccgtacgtaaccctaactttacccttaccgtaaacggtacccttaccccgacggggtaccttagggggaacgggtaacccggaggggtacccttaggtaaacctttactttattcggacctagtaccttctaaagttacttaaccgtagtaaacgtacctaaaaggttcggttaactaccctaaacggttcgggtaccgtttgggggttacccgggaccggggtaaacggggtaacccgtaaacggggtttccggtaacccccggtttaccggtaaccgggtaccgtaacggtaaaccccccggg

SEQ ID NO: 388256 - DNA, 538 bp, Homo sapiens
  misc_feature: GZ8MTXP02GLQXF.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccagcagtgacgttggtgcttataattatgtctcctggttccaacagcattcaggcagccgaccccgaaaactcttaaatttatgtaggttctttcgtcggccctcgtacggggtttctagtcgcttctccggctccaagtctggaccaacaccggcctccctgacccatctctagacctccaggctggaggacgagctagactattattgacagctcatatactagaaacgtcaaagttcggtactccaactggcttggttacggcggtaaggaacctaaaggtcgacccgtctacggtacgacgacccg

SEQ ID NO: 388257 - DNA, 648 bp, Homo sapiens
  misc_feature: GZ8MTXP02F1D22.39.39.D06.1.454.CMB.2.raw
  modified_base (227)..(227): a, c, t, g, unknown or other
  modified_base (240)..(240): a, c, t, g, unknown or other
  modified_base (242)..(242): a, c, t, g, unknown or other
  modified_base (250)..(250): a, c, t, g, unknown or other
  modified_base (252)..(252): a, c, t, g, unknown or other
  modified_base (263)..(264): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctctcactcagggcacggggtcctgggcccagtctggcctgacacagcctgcctccgtgtctgagactcctggacagtcgatcaccatctctgcactggaacccngcagtgagttgtntnttatattntntctctgtacanncatcgagcacgccgaccctaaattacttaattagtgtacgttctttccggtccgtccttacggtacggggtttcctacgttccgtccgtttccgtccggtaccttaccgtacgttcgtacggtaaccaaaccgtacccggtcccttcccgtacgaaccctacttcctactaacgtaccctccgacggtcctaggaacggaacgacgtcgtagtaacttaatttacgtcgactacgtacctactaattaacttacgtaagtaacgtaacgtaagttacggtaactaccgtacgtcggtacgttcgggttaccgggaacgggtaacgggtaaccgtaacggttccgtaacccggttaccgtacggtaccaccggtaacccgaacgg

SEQ ID NO: 388258 - DNA, 719 bp, Homo sapiens
  misc_feature: GZ8MTXP02JJ4VF.39.39.D06.1.454.CMB.2.raw
  modified_base (216)..(216): a, c, t, g, unknown or other
  modified_base (242)..(242): a, c, t, g, unknown or other
  modified_base (270)..(270): a, c, t, g, unknown or other
  modified_base (308)..(308): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctccngcactgaaccagcagtgacgttggtnacttatattatgtctcctggttaccaangctatcaggcacgccgtaccccgaaattcttaatttangtacgttcctttccggccgtccttagtacggggtttctacggtctccgtttcgtcccggcttccgaagttcctacgggccctaaacgcccgtcccttacccgtacgaccctatcccgttcgtaacgtacccgtaccgaacggggtccgtaaggggaaccgggtaccgacgggttacccgttaaggttaaaccgtttaattttacgtaccgtaaccggtaacgtacccgttactaaactttaaacgttaccgttaaacggtaatttacgaaagtttacgggttaacctcccgtaaccggttagggtaccggtttacgggggttaccggggaacgggtaaccgggggtaaccttaacgggtttacccggtacccggtttaccggacggttacccggaacggtttaacccccgg

SEQ ID NO: 388259 - DNA, 532 bp, Homo sapiens
  misc_feature: GZ8MTXP02IY36O.39.39.D06.1.454.CMB.2.raw
  modified_base (332)..(332): a, c, t, g, unknown or other
  modified_base (426)..(426): a, c, t, g, unknown or other
  modified_base (440)..(440): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttccaacagcaattcaggcagcgaccccgaaaactcttaaatttactgaggttctttcgtcggacccctnacggggttttcctagtcgctttctccggctccaaagtctagggcaaacgcgcctaccctgaccatctctagactccaggctgaaggacaggtcngaactattatgcanctcatatactataagtataatacgtactactactagtacgtcgtcggtacggacggaacgaacgtacgtaccgtaccgtacgtacgacgacg

SEQ ID NO: 388260 - DNA, 581 bp, Homo sapiens
  misc_feature: GZ8MTXP02FOWA3.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaacagcattcgaggcacgccgacccccgtaaaacttctttaaatttataggtacggttcctttcggtcggtccctcgtacggggtttctagtcgtcttccgtccggctccgaagtctggaccaaccgtaccggccctccctcgaccctattcctactacgaccctaccgaggtctaggacgggtacgacggtctagtaacttagttagttgacgagtcctactagtatactagaagtactaaagtcggtactccgacgtggtctcgtcggacggtaggaacgtagtcgtaccgtcgtacggcacggtacccg

SEQ ID NO: 388261 - DNA, 636 bp, Homo sapiens
  misc_feature: GZ8MTXP02GDGU1.39.39.D06.1.454.CMB.2.raw
  modified_base (211)..(211): a, c, t, g, unknown or other
  modified_base (229)..(229): a, c, t, g, unknown or other
  modified_base (245)..(245): a, c, t, g, unknown or other
  modified_base (275)..(275): a, c, t, g, unknown or other
  modified_base (316)..(316): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccntctcctgcactggaaccngcagtgtacgttggtntcttaataattatgtctcctggttaccaangctattcaggcacgcccgaccccgtaaattcttaaatttanggtacgtttctttccgccggtccctcggtacggggtttctacgtcgtccttcgtcccggctccgtaacgtctcggaccaaaccgccggtccctcccgtacgaccctactcctactacgtaaccctccgacggtctagggacgggaccgaggtcctaggtaactttatttagtcgaccgtaagtcctactaattacgttactagtaagtactaagttcggtaactccgtacggttcggtcgttacggttaccgggacgggtaaacggtaaccgtaaacggttccggtacccggttaccgtacggtccgaacggtaccccgg

SEQ ID NO: 388262 - DNA, 614 bp, Homo sapiens
  misc_feature: GZ8MTXP02IQNWZ.39.39.D06.1.454.CMB.2.raw
  modified_base (479)..(479): a, c, t, g, unknown or other
  modified_base (556)..(556): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctcccgtcggcggagatgaatggtggagttgggtccgccacgccccgagggaagggctggagttggattggtagaaataaagtggaggaccggggcaaccgaactaacaatcgcgtccctgaggggtcagtacaaccgtatatctgacaagaacaagtaccaaagaaccctacttctaccctagacggctacgacccctgtgtacgacccgccgacggactccggacctaagtatattattgtgacgtagttagttttgacgtaggattcggtagggtcgtagtcgtacgtcgtggggtacaaagggtntacgtacggtctacgtcgtctccgtacacgtccctaccaaccgaaacggccctaacgtcccggttcccttcccccgngggccctccccgtgtccctaccggaacggccgaccaccgcccgagacgaccgaaccgg

SEQ ID NO: 388263 - DNA, 621 bp, Homo sapiens
  misc_feature: GZ8MTXP02IWQRY.39.39.D06.1.454.CMB.2.raw
  modified_base (230)..(230): a, c, t, g, unknown or other
  modified_base (274)..(274): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgacgactccgtggacagtcgatcaccatctctgcactggaaccngcagtgacgttggtgtcttatattatgtcctcctggttaccaancgctattcaggcacgtcctaccccgtaaattcttaatttatgtacgttcttcgtccgtccttacgtacggggtttctacgttcgtctttccgtccgctccgtaagttccgtacggacctaaaccgcccggtacccttccccgtacgaccctactcctctaacgtcctccgtaggcgtaggaacggacgaacggtcttagtacctttatttagtcgactacgtacctcttaatactacgtagtaaagtactaaaagttcggtaaactccgtaacgtcggtacgttcgggtaccggcggtaaacgggaaccttacggtacgtaccgttaccgtacggacgacccgaccg

SEQ ID NO: 388264 - DNA, 629 bp, Homo sapiens
  misc_feature: GZ8MTXP02INETJ.39.39.D06.1.454.CMB.2.raw
  modified_base (183)..(183): a, c, t, g, unknown or other
  modified_base (227)..(227): a, c, t, g, unknown or other
  modified_base (240)..(240): a, c, t, g, unknown or other
  modified_base (247)..(247): a, c, t, g, unknown or other
  modified_base (249)..(249): a, c, t, g, unknown or other
  modified_base (260)..(260): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtntctgagactccgtggacagtcgatcaccatctctgcactggacngcagtgtacgtgnctatatntntctctgtacangcatcgngcacgccgtaaccccgaaattcttaaatttagtaggtacggttctttccgtccggtccgttggtaccggggtttctacgtcgtcgttaccgtccgtactccgtagtcgtacggtaccaaccgtaccggtccctacccgtacgtaaccctacgttcctacgtacgtaaccctccgtaacggtcgtagggacgggacggtagtactacggtaactttatttacgtgctacgactacctattactacgtagtaaagttacaagttcgtactccgacgtcggtcttcggttaccgggacgggaacggtaaccgttaacggttacccgtaacccggttacgtttaccgggaccaccggtaaccccgg

SEQ ID NO: 388265 - DNA, 701 bp, Homo sapiens
  misc_feature: GZ8MTXP02GZT8G.39.39.D06.1.454.CMB.2.raw
  modified_base (228)..(228): a, c, t, g, unknown or other
  modified_base (244)..(244): a, c, t, g, unknown or other
  modified_base (263)..(263): a, c, t, g, unknown or other
  modified_base (269)..(269): a, c, t, g, unknown or other
  modified_base (292)..(292): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactgaaccngcagtgtacgttggtnctatatatgtctctgtcanagcatnagcagccgacccaatcttaattntgtagttcttcgtccgccttgtacgggtttctagtcgtcttcgtccggctccgtaagtcgtacggacctaaccgaccggtcccttaccctcgtaccctaatcctaccgttaacgacccttacccgacggtacgttacgggaaacggggtaaccggaggtacccgttaggtaaaccctttaattttaagtttcccgacggttaacgtaccctttaaccgaaagtttaaccgttaacctttaacggtaaaagtttaaccgttaaaagtttacggggttaaaacccttccccgttaaagttacggggtaccggtttcggggtttaccgggggaccggggtaaacgggtaaccgtaaacggtttaccgggaaaccccgtttccggtaacggttaccgaaccggtaacccccgg

SEQ ID NO: 388266 - DNA, 576 bp, Homo sapiens
  misc_feature: GZ8MTXP02HS36C.39.39.D06.1.454.CMB.2.raw
  modified_base (249)..(249): a, c, t, g, unknown or other
  modified_base (260)..(260): a, c, t, g, unknown or other
  modified_base (385)..(385): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctggggcccaggtcctagggcctgaacacgagcctgcctccgtgtctgagactcctggacagtcgatcacatctcctgcactggaaccagcagtgacgttggtntattataattntgtctcgtgtaccaatgctatcgaggcacgccgaaccctaaattcttaattgtgtacgttcttcgtccgtctggtacggttactagtcgtcttcgcgtctcgagtctcgacacgtccgcctccgntaccatctactacgtacctcgaggtctaggacggacgtagcttagtacttagttagtgacgtacgtactactaactaacgtacgtagtaacgtaagtaagtacgttacgtacctacgtacggtacgtacggttcgggtacggtaacggtaacgtaacgttaccggtaccgtacgtacgtacgtacgtaccg

SEQ ID NO: 388267 - DNA, 623 bp, Homo sapiens
  misc_feature: GZ8MTXP02JCV7G.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaacagctattcaggcacgccgaccccgtaaacttctttaaatttatgtacggttctttcgtccgtcctcggtacggggtttctaggtcgtcttcgtccggtctccgaagtcgtcggaccaaccgccggtccctccctacgaccctatctactacgtacctccagggtcctaggaacgggacgaggtctagtaactttattacgttcgactaagtcctactaattaacgtacgtaggaaacgttacgaaagttcggtaactacccgtaacggttcggtaccgttcgggttaccggggacgggtaacgggaaccgttaaggtaccgtacccggttacgtacggtaccacggacccg

SEQ ID NO: 388268 - DNA, 601 bp, Homo sapiens
  misc_feature: GZ8MTXP02HOZ57.39.39.D06.1.454.CMB.2.raw
  modified_base (365)..(365): a, c, t, g, unknown or other
  modified_base (397)..(397): a, c, t, g, unknown or other
  modified_base (572)..(572): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctccctcggcggagatgaatggtggagttgggtccgcagccccgagggaagggctggagttggattggtagaaataaagtggaggaccgggggcaaccgaactacgaaatcgccgtccctacgaggggtacgaggtccaccatactctgacagaacaagtccaaagaaccacttctccctgacgctgacccctntgtcgaccgcgcgactcggccatatattatgntcgagtagtttgactaggatgttaggggcgtagtcggacgtcggtgggacgaggtactacggacgtacacgtcgtacctccgtacgacgtcccacccgaaccgacgggacccctacgtcccggtttccccttcccccggcggtccccgtcccgtcgacccgtaccgaacggaccncccgacccgacgaccggacacgaacccgg

SEQ ID NO: 388269 - DNA, 569 bp, Homo sapiens
  misc_feature: GZ8MTXP02H3D5A.39.39.D06.1.454.CMB.2.raw
  modified_base (226)..(226): a, c, t, g, unknown or other
  modified_base (269)..(269): a, c, t, g, unknown or other
  modified_base (306)..(306): a, c, t, g, unknown or other
  modified_base (449)..(449): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaacngcagtgacgttggtgcttataattatgtctcctggttccaacngcattcaggcagccgacccccgaaaatcttaatttangtaggttctttcgtcgccctgtacggggtttctagtcgcttctccggctcaagtctggcaacacggcctccctgaccatctctacgacctcctacgggctaggaggaccgaggctcggaacttatttagtcgcgtagtcctanattaatactggaaactactaaagttcggtaacttccgaaccgttggacgttcggttaccggggacggtacggggaaccctaaggtttacgacccgttcgtaacgggtcaacgggaccccg

SEQ ID NO: 388270 - DNA, 703 bp, Homo sapiens
  misc_feature: GZ8MTXP02J0OXU.39.39.D06.1.454.CMB.2.raw
  modified_base (231)..(231): a, c, t, g, unknown or other
  modified_base (274)..(274): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatcctcctgcactggaaccngcagtgacgttggtgtcttataattatgtctcctgttccaacngcattcagcacgaccgacccccgtaaacttcttaatttatgtaggttcctttccggtccggtcccgtcgtacggggtttctagtccgtccttcgtcccggcctccgtaagtcgtcggaccaaccgtacccggtcccttccccgtacgtaccctacttcccttaccgtaacgtaccctaccgacgggtacccgttagggaacgggaccgtacgggtaccttacggtaacctttaagtttacgtttcgacgtaagtcctacgtaattaacgttacgttaggtaaacgttaccgtaaagttacgggttaacctacccgtacgttcggttaccgtttcggggttacccggggtaccgggtaaacggggtaaccgttaaacgggtttaccggtacccggttaccggtaacggttaccggaccggtaacccccgg

SEQ ID NO: 388271 - DNA, 619 bp, Homo sapiens
  misc_feature: GZ8MTXP02I3688.39.39.D06.1.454.CMB.2.raw
  modified_base (271)..(271): a, c, t, g, unknown or other
  modified_base (342)..(342): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctcctgcactggaaccagcagtgacgttggtgtcttataattatgtctctgtaccaangcatcagcagccgacccgaattcttaatttatgtagttctttcgcgtcctgtacgggtttcagtctcttcnccgctccgagtcgtcgacaacgccggccctccctagacccatctactaacgcctaccgacggctaggacggacgacggtctagtaacttagtttattcggacgtacgccttacaattaactaaactaacgtacttaaacttattaccgttacggtttggggttcgggtttacggggaccgggggtaccgggtaaacccgtacccggttaccggtaacccggtttacggttaacggttccgaaaccggtaccccgtaaagggtcccgttacccccggg

SEQ ID NO: 388272 - DNA, 678 bp, Homo sapiens
  misc_feature: GZ8MTXP02GFDD1.39.39.D06.1.454.CMB.2.raw
  modified_base (242)..(242): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctctgcactggaaccagcagtgacgttggtncttatattatgtctcctggttccaacagcattcaggcagccgaccccgaaacttcttaaatttatgtacggttctttcgtccgtccttgtacgggtttctagtctcttcgtccggctccaagtctggacctaaccgaccggtccctccctagaaccctactccttacctaacggacccttacccgaggtccgtacgggaacgggaccgtacgggtaccgttaggtaaaccttagtttaagttcggaccgtaagtcccttactaaattacgttaaacgtaggtaaagttacctaaaaggttacgggttaacctacccgtaaaggttcgggtcgtttacggggttacccgggacggggtaaaaccggggtaacccgtaaaacgggtttccggaaccccggttaccggttaacgggtacccgaaccggtaacccccggg

SEQ ID NO: 388273 - DNA, 559 bp, Homo sapiens
  misc_feature: GZ8MTXP02ILM37.39.39.D06.1.454.CMB.2.raw
  modified_base (271)..(271): a, c, t, g, unknown or other
  modified_base (382)..(382): a, c, t, g, unknown or other
  modified_base (416)..(416): a, c, t, g, unknown or other
  modified_base (461)..(461): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatctctgcactggaaccagcagtgacgttggtgtcttatattatgtctcctggtccaacngcattcagcacgccgaccccgaaactcttaatttatgtagttcttcgtccgcctcgtacggggttctagtcgtcttcgtccggtctcgagtctggaccacacggcctcccncgaccatcactacgactcgaggctaggacgacgnggctagtacttattattgcagtcctacattatacgtgtaaacgtnaaacttcggtactaccgtacgttcggcgttcggttacgggcggtaaacggaaccgtaacggttcggtacccggtacgtacggtaccgacgtaacccgg

SEQ ID NO: 388274 - DNA, 602 bp, Homo sapiens
  misc_feature: GZ8MTXP02F0ASD.39.39.D06.1.454.CMB.2.raw
  modified_base (229)..(229): a, c, t, g, unknown or other
  modified_base (269)..(269): a, c, t, g, unknown or other
  modified_base (374)..(374): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatgtctctggttccaanagcattcaggcacgccgaccccgaaacttcttaatttatgtaggttctttcgtcgtccctgtacggggtttctagtcgtcttctccggctccgagtctgacaacncggcctccctagacctactctactacgacctaccgaggtctaggacgggacgaggacgtgaacctttatttagtttgacagtctacgattactaacgtagtaaacgtctaaagttcgggtaactaccgtaacgttcggtcgtttacgggttccgggacggggtaaacgggtaaccgtaacgggtttacggtacccgttaccgttaacggtaccgacggtaaccccggg

SEQ ID NO: 388275 - DNA, 626 bp, Homo sapiens
  misc_feature: GZ8MTXP02GCA6M.39.39.D06.1.454.CMB.2.raw
  modified_base (228)..(228): a, c, t, g, unknown or other
  modified_base (243)..(243): a, c, t, g, unknown or other
  modified_base (266)..(266): a, c, t, g, unknown or other
  modified_base (297)..(297): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccngcagtgacgttggtnacttatatatgtctctgtaccangctatcagcagccgaccctaattcttaattntgtagttcttcgccgtccttgtacgggtttctagtcgtcttcgtccgctccgaagtctggaccaacgccggtccctaccctgaccctactctacgtacgacccttccgaggtcgtaggaacgggaccgaggtaccttagtaaacctttagtttacgtcgggaacctagtacccttacgtaatttaacgtaacgttagtaaacgttacgtaaagttacggttacctaccgtaacgttcgggtacgttcggggttaccgggacgggtaaacgggtaaccgttaacgggttaccgtacccggttacgtacggtacccgaacggtaaccccgg

SEQ ID NO: 388276 - DNA, 833 bp, Homo sapiens
  misc_feature: GZ8MTXP02JDGNX.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctccgtggttccaaacagcatttcaggtcacggccgaccccgaaaactacctttaaatttataggtacggtttcttttacgtccggtcccgttcgtacggggttttctacggttcgtcctttcgtcccggtcttcccgtaaagttccgtcggtaccaaccgtaaccgggtccccttacccgtacgtaaccctaacttcccttaccgttaaccggtaaccctttaccccggaaacggggtcccgttacgggggtaaacggggaacccgggaacgggggtaccgtttacggggtaaaacccttttaagtttttaaaaccggtttcgggggtaccccttaaaacggggttcccgtttacccgtaaaagtttaaacctttaaacccggttagttaaaaccggttaacgtaaaaacgtttcgggggttaacttaccccggtaaacgtttacggggtaccgttttcggggtttacccgggggaccggggtaaaacgggggtaacccgtttaaaaacggggtttccggtaaaacccccggtttcccggttaacggggtacccgtacgggttaaaaccccccggg

SEQ ID NO: 388277 - DNA, 568 bp, Homo sapiens
  misc_feature: GZ8MTXP02G0O55.39.39.D06.1.454.CMB.2.raw
  modified_base (228)..(228): a, c, t, g, unknown or other
  modified_base (268)..(268): a, c, t, g, unknown or other
  modified_base (340)..(340): a, c, t, g, unknown or other
  modified_base (360)..(360): a, c, t, g, unknown or other
  modified_base (370)..(370): a, c, t, g, unknown or other
  modified_base (374)..(374): a, c, t, g, unknown or other
  modified_base (400)..(400): a, c, t, g, unknown or other
  modified_base (418)..(418): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctctgtcaacancatcaggcagccgacccgaaattcttaatttatgtagttcttcgtcgccctgtacgggtttcagtcgcttcnccgctcgaagtctggacacncgcctccctnaccntctctacactcgaggctaggagacgngtctgtaacttattagtnctagtctactaatatacgtagaaacgtactaaagttcggtaacctcctacgtcggtccgttcgggttccggggaccgggtaaacgggtaacccgttaacgggttaccggaaacccggttccgtaaacgggttccgaaccggtaaccccgg

SEQ ID NO: 388278 - DNA, 599 bp, Homo sapiens
  misc_feature: GZ8MTXP02HWUVI.39.39.D06.1.454.CMB.2.raw
  modified_base (273)..(273): a, c, t, g, unknown or other
  modified_base (416)..(416): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctctgcactggaaccagcagtgacgttggtgtcttataattatgtctcctggttccaacngcattcaggcacgccgacccccgaaacttctttaatttatgtaggttcttcgtccgcctcgtacggggtttctacgtcgcctttcgtcccggtctccgaaagttcctgggacctaaaccgaccggccttccccgtgaaccctnttacctcctagacccttccgaggtccttaggacggtacgagggcttaggtaacttattattgactagctcgaattactacgttagaaagtctaaattcggtaaatccctaacgtggtcgttgttaccgggcggtaacggggaacctaaggttcgtacccggtactacggtcaacggtacccgg

SEQ ID NO: 388279 - DNA, 579 bp, Homo sapiens
  misc_feature: GZ8MTXP02I1YNA.39.39.D06.1.454.CMB.2.raw
  modified_base (184)..(184): a, c, t, g, unknown or other
  modified_base (229)..(229): a, c, t, g, unknown or other
  modified_base (268)..(268): a, c, t, g, unknown or other
  modified_base (302)..(302): a, c, t, g, unknown or other
  modified_base (343)..(343): a, c, t, g, unknown or other
  modified_base (469)..(469): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggccccagtctggcctgacacagcctgccctccgtntctgagactcctggacagtcatcaccattctctgcactggaaccngcagtgacgttggtgcttatattatgtctctgtaccaangcattcagcagccgaccccgaaattcttaatttngtacgttcttcgcgccctatacggggtttctagtctcttcnccggctcaatctggccaacgtacgcctccctgacctagtctacagcctacaggtctggaacggaccgaggtctacgtaactatttatcggacagtccttacaatttataaccgtgtaaaaccgttntaaagttaccgtactaccgtacgtcggtacgtttacgggtaccggtaacgggtaacggtaacgtaacggttaccgaaacccggttcggtaacggtaccgaaccggacccg

SEQ ID NO: 388280 - DNA, 575 bp, Homo sapiens
  misc_feature: GZ8MTXP02INVG5.39.39.D06.1.454.CMB.2.raw
  modified_base (229)..(229): a, c, t, g, unknown or other
  modified_base (269)..(269): a, c, t, g, unknown or other
  modified_base (301)..(301): a, c, t, g, unknown or other
  modified_base (451)..(451): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctggagactcctggacagtcgatcaccatctcctgcactgaaccngcagtgtacgttgtgtcttatattatgtctcgtgtccaangcattcagcacgcgaccccaattcttaatttnagtagttctttcgcgcctgtacgggtttcagtcctcttcgccgtctcgagtcgtcgacaccgtacgcctacctgaccagttcacgtacacctccgaggtctacggagtacgagctagtacttattagtcacgtaatctaactaacgttanaacgttagaaagtacgtaagttaggtaaacctccgtaaagttcggacgttttacgggaccgggtacgggaacgggtaaccctaaggttcccgaccgttcgttaccggaccgtacgtaaccccgg

SEQ ID NO: 388281 - DNA, 663 bp, Homo sapiens
  misc_feature: GZ8MTXP02IR27W.39.39.D06.1.454.CMB.2.raw
  modified_base (274)..(274): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtcgacgttggtgtcttataattatgtctcctggttaccaanagcattcaggcacgccgaccccgaaactacttaaatttatagtagttctttccgtcggacctcgtacggggtttctagtccgtcttcgtccggtctccgtaaagttcgtcggacctaaaccgccggtcccttccctacgaccctagttacctcgtacgaccttcccgaaggtctaggaacggcgaacgggcttacggtaacttaatttaagttgacgtactcctactaattactaaccgttaggtaaacgttactaaaagttaggttaaccttaccgtaaccgtagggttacttcggggttaacgggaccgggtaaaccggggtaaaccgttaacgggtttacggaccccggtttacgtaccgggttaaccgtacccggtaacccccgg

SEQ ID NO: 388282 - DNA, 642 bp, Homo sapiens
  misc_feature: GZ8MTXP02HE3UM.39.39.D06.1.454.CMB.2.raw
  modified_base (346)..(346): a, c, t, g, unknown or other
  modified_base (379)..(379): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaagggctgagttggattggtagaaataatgaggacggggcaccaactacaatgcgtccctcgagggtcgagtcaccatatctgcagacaagtccaagaaccacttctccctgacggctgacccctntgtcgaccgcgcgactcggccatatattattgngcgtagtagttttgcgtaggtagttcgttgggggtccgtagttacggtacgttcgtgggggtacgtaaaggggtactccgtaacgggttcctacgttccgtcccttacccgtcctaccggtccccttacccgaaccccggaaaccggggccccctaacggttccccggtttccccgttcccccggtcggtcccccggtcccccgttcgcccgtacccgaacggaccggacccaccccgtcccggacgaccgacccgaacccgg

SEQ ID NO: 388283 - DNA, 645 bp, Homo sapiens
  misc_feature: GZ8MTXP02GSKFS.39.39.D06.1.454.CMB.2.raw
  modified_base (284)..(284): a, c, t, g, unknown or other
  modified_base (399)..(399): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactccgtggacagtcgatccaccatctcctgcacgtcgaaccagcagtgtacggttggtgtacttaataattatcgttcctccgtggttaccaacngtctattcgaggcacgcccgaaccccgtaaattcttaaatttagtgtacggtttcctttcggtccggtccccttggtacggggtttctagtccgtctttccgccgtctccagtcnggaccaacgccgtcctccctcgacctactctactacgccctcgaggtccgtaggacgggacgacggtctacgtaacttatttacgtagactacgtacgtactaattaagtaacgtaggtaaagttacgtaaaagttcggtaacctaccgtacgttcgggtacgttcgggtaccgggacgggtaaacggggtaaccttaaacgggttccggtaacccgtccggtaacggtaccgaaccgtaccccgg

SEQ ID NO: 388284 - DNA, 645 bp, Homo sapiens
  misc_feature: GZ8MTXP02ILLT9.39.39.D06.1.454.CMB.2.raw
  modified_base (189)..(189): a, c, t, g, unknown or other
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctganactcctggacagtcgatcaccatctcctgcactggaaccngcagtgacgttggtgtacttataattatgtactcctgttaccaacagctattcaggtcacgccgtaccccgtaaattacttaatttatgtaggttcctttccgtccggtcccttcgtacggggtttctacgtcgtccttcgtcccggtctccgtaacgtctacggacccaaccgtaccggtccctccccgtagaccctactccgtactacgtaccctaccgaacggtcgtaggacggtacgaggtacctacgtacttaagtttagttcgacgtaacgtctactaagttactacgtagtaaagtactaaagttacggtactacccgtacgtggtccgttacgggttaccgggacgggtaacgggtaaccgtaacggttcgtaacccggttaccgtacggtaccgaacggtaaccccg

SEQ ID NO: 388285 - DNA, 703 bp, Homo sapiens
  misc_feature: GZ8MTXP02H21KK.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcacgtacggaaccagccaggtggtacggttggtcgtacttaataatttatcgttcctcccgttcggtaccaacagtactagttcgacggcacggaccccgaaccccgtaaatttacttaaatttagtggtacgttctttccggtccggtccctggtacggggtttctacgtccgtccgttccgtccggtacctaccgtaacgtctacgacctaaaccgccggtccctcccgtacgaccctattcctacgtacgacctaccgaggtccgtaggaacggtacgaggtctacggtaactttagttagttcgacgtacgtctactaaagttacgttacgtaaagtaacgtactaaaggttacggtaaccttacccggtaacggttcggtccggtttacggggttaccggggaaccggggtaaaccgggtaaaccgtaaacggttcccggtaacccggttacgtaccgggtaccgaaccggtaccccggg

SEQ ID NO: 388286 - DNA, 701 bp, Homo sapiens
  misc_feature: GZ8MTXP02F70QM.39.39.D06.1.454.CMB.2.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaacagctattcgagcagccgaccccgaaaacttctttaaatttactggtacggtttcctttccggtaccggtccccttcggtaccggggttttctacgttcgtcctttccgtcccgggtcttcccgtaaaggttccgtacgggacctaacccgtacccggtcccttccccgtacgaccctaacttcctaccgtaacgtaccctacccgaacgggtcctacgggaacgggaaccgacggtactacggtaacctttaagtttacgtttacggaccgtaagtcctactaaattaactacgtagtaaacgtaccgtaaaagttacggttaacctacctaacggttcggaccgttcgggttaccgggcgggtaaaaccgggtaacgtaaacgggttacggtaccccggttacgtaacgggttaccgacggtaaccccg

SEQ ID NO: 388287 - DNA, 677 bp, Homo sapiens
  misc_feature: GZ8MTXP02JKZGZ.39.39.D06.1.454.CMB.2.raw
  modified_base (276)..(276): a, c, t, g, unknown or other
  modified_base (384)..(384): a, c, t, g, unknown or other
tcagtcgcactagtcacgaccggtgctcgatttagtgacatctcggcagttctttggggggggtctcaggaggcagcgctctcaggacatctcccaccatggcctgggctctgctgctcctcaccctcctcactcagggcacagggtcctgggcccagtctggccctgacacagcctcgcctccgtgtctgagactcctggacagtcgatccaccatctcctgcactggaaccagcagtgacgttggtgcttataatatgtctcctggtaccaacngcattcgaggcacgccgaccccgaaattctttaaatttatggtaggttctttcggccgtcccctgtacggggtttctaggtcgtcttcgtccggtctccgaagttccngggtacaaccgtaccggtcccttaccctacgacctacttcctactacgacctcccgaacggctacggaacgggacgacgggtacctaggtaaccttatttaagtcgacgtacgtactaccgtaattaactaccgtagtaaacgttcgaaacgtttacgggtactcccgttaaacggttcgggtaccgttacgggggtttaccgggacgggggttaaacggggtaacccgttaaacgggtttccgaacccccgggttacggttaaaccgggtccctaaccggggtaacccccgg

SEQ ID NO: 388288 - DNA, 570 bp, Homo sapiens
  misc_feature: GZ8MTXP02JELAJ.39.39.D06.1.454.CMB.2.raw
  modified_base (229)..(229): a, c, t, g, unknown or other
  modified_base (270)..(270): a, c, t, g, unknown or other
  modified_base (469)..(469): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatgtctctggttaccaanagcattcaggcagccgaccccgaaattcttaatttagtgtaggttctttcgtccgtcctcgtacggggtttctagtctctttcgtccggctcccgaagtctcgggaccaacgaccggtccctccctacgaccctattcctactacgcctccgaggcctagggacggacgaggtactggaacttatttactgacatctanatatactgaacgtcaagttcgtaactccacgtcggtcttggtaccggacgggaacggaaccgtaaggttcggacccgttacgtacggtaccacgaaccccg

SEQ ID NO: 388289 - DNA, 683 bp, Homo sapiens
  misc_feature: GZ8MTXP02GFAN2.39.39.D06.1.454.CMB.2.raw
  modified_base (227)..(227): a, c, t, g, unknown or other
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctctgcactggaaccngcagtgacgttggtgcttataattatgtctcctgttaccaangctatcaggcagccgaccccgaaattctttaaatttacgtgtaggttctttcggtccggtcccttacgtacggggttttctacgttcgtcctttccgtcccggtcttcccgaacgttcgttcgggaccaaaccgtcccgggtccccttccctacgaaccctacttccctacgttacgacccttccgaacgggtctacgggaacgggacggacggtacttacggtaaacttagtttaagttcgacgtaacgtaccttactaaatttaacgtaacgttaggtaaaacgttaaccgtaaaagtttcgggtaacttacccgacggttcggtacgttcggggttacggggacgggtaacggggtaaccgttaaaggttccggaacccggttcggtttacggtaccgacggtaaccccgg

SEQ ID NO: 388290 - DNA, 722 bp, Homo sapiens
  misc_feature: GZ8MTXP02IFQU9.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcaagtgacgttggtgcttataattatgtctctgttccaactagcatttcaggcagccgaccccgaaacttacctttaaatttatcggtaaggttcctttccgtccggtcccctgtacggggttttcctagtccgtcttcgtcccggcttccaacgttctcgggactaaccaccgggtccctccctacgtacccaattcctactaacggacctacccgaggtccttaggacgggacgaacggcgttacggtaaaccttagtttaacgtttcgaccgtaagtccttacctaaagttacttaaaccgttagtaaaagttacccgtaaaagtttacgggttaaactacccgttaaacggttacggggtacccgtttaggtttcccgggggaccggggtaaaacgggggtaacccgtttaaaaacgggggtttccggtaaaaccccgggttttccccgttaaacggggtttacccgaaacccgggtaaacccccggg

SEQ ID NO: 388291 - DNA, 650 bp, Homo sapiens
  misc_feature: GZ8MTXP02JIR5L.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcacgccgaccccgtaaattcttaaatttatggtaggttctttacggtccgcccttggtacggggtttctagtcgtctttcgccggctccgaagttcgtacggaccaacgccggtccctcccgtacgaccctactctacctagtaccctaccgaggtctagacggacgtaggtcctagtaccttagtttagtcgactagacctactaatacgttaacctggtaaactacgtaaaacgttagggtaaccttaccgtaacgttcgggtacctttcggggttacccggggacgggtaaccgggtaaccgttaaaacggttccgggtaaacccccggttaccgttaaccgggtaccgtacccggtaaacccccgg

SEQ ID NO: 388292 - DNA, 610 bp, Homo sapiens
  misc_feature: GZ8MTXP02G761K.39.39.D06.1.454.CMB.2.raw
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgtcttataattatgtctctgtcaangcatcagcagccgacccgaaatcttaattatgtagttcttcgtcgcctgtacggggtttcagtcgtcttcgtccggctccgagttcgtggaccaaacgcggccctcccgtgaccctatctacgtagacctcgacggctaggaacggacgaggctagtaacttagttatcgacgtagcctactaattactaacgtagtaaacgtactaagttacggtacttacccgagttcgggtaccgtttcggggttacccggggacgggtaaacgggtaaccccgtaaaggggtttacccggtaacccggttaccggtttaaccggtacccgtaaccggtaaacccccggg

SEQ ID NO: 388293 - DNA, 516 bp, Homo sapiens
  misc_feature: GZ8MTXP02IC1HU.39.39.D06.1.454.CMB.2.raw
  modified_base (229)..(229): a, c, t, g, unknown or other
  modified_base (479)..(479): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatgtctctggttccacagcattcaggcagccgaccccgaactcttaatttatgtagtctttacgtccggtccctcgtacggggtttctagtccgtcttctccggctccaagtctggcaccacggccctccctcgaccatctctacgactccagctgacggacgaggctagacttattattgcaagctacatatactgatacaatcgtatccactcggctcgtacggnggacggcgtaagtcgaccgtcgacggtcacgtacccg

SEQ ID NO: 388294 - DNA, 595 bp, Homo sapiens
  misc_feature: GZ8MTXP02IH75A.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctctggttaccaanagcattcaggcagccgacccccgtaaactacttaatttatgtagttctttcgtccggcctcgtaggggtttctagtcgtcttcgtcccggcttcctaagtcctggccaacgaccggtccctcccttcgaacctcgtccctacgtacgaccttccgacggtcgtggagggacgaggtccgtagaacttacttattcgactagctacagttataactgaaagttacaagttacggtactccacgttcggtcgttcgggttaccggggcggtaacgggtaaccgtaacggttccgtaccggtacctacgggtaccacggtaaccccgg

SEQ ID NO: 388295 - DNA, 731 bp, Homo sapiens
  misc_feature: GZ8MTXP02JCB5L.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctccctcggcggagatgaatggtggtaggttgggtccgccgacgccccgaggggaagggctggaggttggagttggtagaaaataaagtggaacggacccggggacaaccgaactacaagtcgccgtcccgtcgaggggtcgacgtcaccatatctgacacgaacaagtaccaaacgtaacccacttcctcccgtgacggtctcgacccctcgtcgtcgacccgccgcggactccggacctatattattagttgtacgcgtaagtttaggtttttgacgttgaaacgggttacgtttcggggacgggggttacggaccggtttacgtacgggtttcggggttacggggtaaaccgggtaaggtacgtaccgtaccggtaccgttacgtcccggttcccgttccctacggaccccttaccccgtaaccccgaaaaccgggtaaccccggtcccctacggttcccggttcccccgttcccccggtccggtccccgtccgtacccgcccgtaaccggacggaccgaccccgtaacccgtccccggaaaggacccgtaacccgg

SEQ ID NO: 388296 - DNA, 524 bp, Homo sapiens
  misc_feature: GZ8MTXP02FUPTW.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctgttccaacagcattcaggcagccgccccgaaaactcttaaatttatgaggttctttcgtcgccctcgtacggggtttctagtcgtcttctccggctccaagtctggcaacgacgccctccctgacccatcctactacgaccttccgaggctgacggacgagctagacttattattgcagctacatatactgaatcaatcggtaatccactggtctgttcggcggaggaaccgtaaggtcgaaccgtctaaggtcacgacccg

SEQ ID NO: 388297 - DNA, 771 bp, Homo sapiens
  misc_feature: GZ8MTXP02JFW25.39.39.D06.1.454.CMB.2.raw
  modified_base (229)..(229): a, c, t, g, unknown or other
  modified_base (272)..(272): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacngcattcaggcacgccgaccccgtaaacttctttaaatttagtagtacggtttctttaccgtccggtccccttcgtacggggttttctaacgttccgtcctttccgtccccggcttccgtaaagttcccgttgggacccaaacccgtaccggggccccttccccgtacgacccctaacgttccttaccttacggtaacccttcccgagggtccttacgggaacggggtaacgacggggtccttacgggtaaacctttacgttttaacgttagaacccgtaaggtcccgttaaccgtaattaaacttaaaccgttaggaaaaccgtttacgtaaaacggtttacgggtttaaccctacccgtaaaccggttacgggtccgttttcgggggtttaccccggggaccgggtaaacgggggtaacccgttaaaacggggtttccggtaaaccccgggtttacccgttaaaaccgggggtccttaaaccggggtaaaccccccgg

SEQ ID NO: 388298 - DNA, 594 bp, Homo sapiens
  misc_feature: GZ8MTXP02I1ZUQ.39.39.D06.1.454.CMB.2.raw
  modified_base (230)..(230): a, c, t, g, unknown or other
  modified_base (245)..(245): a, c, t, g, unknown or other
  modified_base (255)..(255): a, c, t, g, unknown or other
  modified_base (257)..(257): a, c, t, g, unknown or other
  modified_base (269)..(269): a, c, t, g, unknown or other
  modified_base (301)..(301): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctcctgcacgtggaaccngcagtgtacgttgtnacttatattntntctctgtacaangctatcaggcagccacccgtaatcttaatttngtacgttcttcgcgtcctcgtagggtttctacgtcgtccttcgtccggcttccgaagtcgtacggacctaaccgaccggtccctccctacgacctacttcctactacgaccttaccgacggtctaggacgggacgaggtctaggtattagtttatcgtacgtacgtctactaattaccgtaataggtaatacgtaaagttcgtaacctctaacggttgtcgttcggtacggggtacggaacggtaacgtacggttaccggtaccgtaccgtaacggttcgaaccgtaacccgg

SEQ ID NO: 388299 - DNA, 758 bp, Homo sapiens
  misc_feature: GZ8MTXP02HRSA8.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgccgctgtgtctggacgcctccgtcggcggagatgaagtgggtggaggttcgggccgccaccggcccccggaagggggaacgggcgtaggtaggttgggtagttgggtaagaaaagtaaagtggaacgggaccggggaccaaaccgaactaacaatcggccgtccccgtacggacggggtccgaacggtaccaaccgtataactctgaccaacgaaaccgtaacgtaccaaaacgaaacccttacgttccctacccgtaggacggtcctacgtacccccgtcgtcggtacgacccgccggaccggacgtccggacctaagtaattacgttagttcggtgacggtagtttagtttcgacgtagggtacttcgggttcgggggtcgttaacgtcgggacggttcgggtaggggacgtagggacttcggtaacggtctacgttcccgttcctccgttaccgaccgtcccgtaacccggaacccggaaaccgggttcccctaaccgtttcccccgggttaccccttcccccggtaccggtccccgtacccgtccgtcccgaccggaacggtcccgaacccgttcccgaccgacgaccgacggacccgg

SEQ ID NO: 388300 - DNA, 539 bp, Homo sapiens
  misc_feature: GZ8MTXP02FWWBI.39.39.D06.1.454.CMB.2.raw
  modified_base (268)..(269): a, c, t, g, unknown or other
  modified_base (274)..(274): a, c, t, g, unknown or other
  modified_base (294)..(294): a, c, t, g, unknown or other
  modified_base (333)..(333): a, c, t, g, unknown or other
  modified_base (347)..(347): a, c, t, g, unknown or other
  modified_base (364)..(364): a, c, t, g, unknown or other
  modified_base (432)..(432): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactacggaaccagcagtgacgttgtgcttatattatgtctctgtacacnncatcngcagcacccaatcttaattngtagttcttcgcgtcctgtacgggtttcagtctcttacnccggcttccagtcngtacaacacgcctcccngacatctactagactcaggtctagaggacgtaggctgacttatattcgactagctacaatattaacgnggtaaaactctaaaagtcggtaactcccaagttcggacttcgggttacggacggacggggtaaacctaaaggttccggacgttacccgtaggtaccacggtaacccg

SEQ ID NO: 388301 - DNA, 505 bp, Homo sapiens
  misc_feature: GZ8MTXP02FO8P9.39.39.D06.1.454.CMB.2.raw
  modified_base (304)..(304): a, c, t, g, unknown or other
  modified_base (323)..(323): a, c, t, g, unknown or other
  modified_base (431)..(431): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagcgccccgaaatcttaatttangaggtctttcgcggccctntaggggtttctagtcgtcttctccggctccaaagtctggcaacacggcctccctgaccatctactacgactccaggcctgaggacgaggctgactattattgcagctnatatactgaaatcaaatgtatccactgctgttcggcggtaggaaccaagttcgacgtctacggtcacgtacccg

SEQ ID NO: 388302 - DNA, 559 bp, Homo sapiens
  misc_feature: GZ8MTXP02JPWSM.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcacgccgaccccgaaactcttaaatttatgtaggttctttcgtccggtccctcgtacggggtttctagtcgtcttctccggctccagtctggcaacgcgcctccctgacctatctctacgacctcacggctaggacggacgacggctgtaacttattagtgctagcttactactatactagtaacgtacaagtcgtactccaacgtcggtcgttcggttcgggacggacgggtaaccgtaaggttcgacccggttacgtacggtacgacgtaacccgg

SEQ ID NO: 388303 - DNA, 625 bp, Homo sapiens
  misc_feature: GZ8MTXP02G1PZZ.39.39.D06.1.454.CMB.2.raw
  modified_base (244)..(244): a, c, t, g, unknown or other
  modified_base (254)..(254): a, c, t, g, unknown or other
  modified_base (268)..(269): a, c, t, g, unknown or other
  modified_base (291)..(291): a, c, t, g, unknown or other
  modified_base (298)..(298): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtnacttatattntgtctctgtccaanncatcagcagccgacccgaaatnttaattngtagttcttcgcgcctgacgggtttcagtcgtcttcgccggctcgagtctggaccaacgcgcctccctgacctatctactacgactccgaggtctaggaacggaccgaggtacctagtaaaccttatttagttcggacctagtaccctacgtaatttacgttaaaccgtaggtaaaacgttaccgaaaagtttcgggtaaccttaccccgtaacgtttcgggtcctttacgggggtaccgggaccggggtaaacgggtaacccgtaaacgggtttacccggaaccccggtttccggtaacgggttaccccgaaccggtaacccccgg

SEQ ID NO: 388304 - DNA, 688 bp, Homo sapiens
  misc_feature: GZ8MTXP02JSSJU.39.39.D06.1.454.CMB.2.raw
  modified_base (226)..(226): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccatcctcactcagggcacagggtcctgggcccagtctggcctgacacagcctgcctccgtgtctgagactcctggacagtcgatcacatctctgcactggaaccngcagtgacgttggtgtcttataattatgtctcgtgtaccaacagctattcgaggcacgaccgaccccgtaaacttactttaaatttactggtacggttactttccggtccggtccttaccggtacggggttttctacggtcgttcttccgtccggtcttcccgtaaaggtccttaggccaacgtacccggtccctaccctgaccctatctactacgtactccgaaggtcgtagaacggacggtagggaccttaggacctttaagttactttacggactaacgtcctaacgttattaactaaccgtagtaaaacggtacttaaagttacgggttaactacccgtaacgttacggtccgttaacgggtttccgggggaccgggtaaacgggggttaacccgttaaaacggggtttccgggtaaacccggtttaccccggtaagggttacccgtaaaacccgggg

SEQ ID NO: 388305 - DNA, 587 bp, Homo sapiens
  misc_feature: GZ8MTXP02FM52I.39.39.D06.1.454.CMB.2.raw
  modified_base (278)..(278): a, c, t, g, unknown or other
  modified_base (319)..(319): a, c, t, g, unknown or other
  modified_base (409)..(409): a, c, t, g, unknown or other
  modified_base (440)..(440): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtacttaataattatgtacctcctggttaccaaancgactattcaggcacgccgaccccgaaaattctttaaattngtacgttctttcgcgccctgtacgggtttctagtcgtcttccgccggcttcgaagtctaggaccaaacgccggccctaccctagaacctntcctcacgacctccgagtcgaggacggacgngacttagaacttatttagtgacagtcctataactaactacgttagaaatacgaattaggtacctactacgttcggtcttaccgggttcggaacgggtaaggaacccgttaaagggttccaaaccgggtctacggtacacgaacccgg

SEQ ID NO: 388306 - DNA, 718 bp, Homo sapiens
  misc_feature: GZ8MTXP02GXXV8.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgtacgttggtgtacttaataattatcgtcctccgtaggttaccaaactacgtctaattcacggcacggcccgaaccccgtaaaacttctttaaatttacgtgtaggtttcctttaccggtccggtccccgttggtaccggggtttctaggtccgtcttccgtcccggtctccgtaagttcgtacggaccctaaaccgcccggtcctaccccgtagtaccctatcctacgtacgaccctacgacggtcgtacggaaacgggtaccgacggtaccttacggtaaaccttatttacgtacgtactacggtaccttaactaactttaaagttaaccgtaagggtaaaacttacgtaaaacgttacggttaaacctaccgtaaccggtggttccgtttacggggtaccgggaccggggtaaacgggtaacgttaaacgggtttaccgaaacccggttacgttaacgggtaccgtaccggtaacccccgg

SEQ ID NO: 388307 - DNA, 657 bp, Homo sapiens
  misc_feature: GZ8MTXP02FVRW5.39.39.D06.1.454.CMB.2.raw
  modified_base (306)..(306): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttaccaacagcattcagcagcgaccccgaaaatcttaatttanggtagttcgttcgccgtccgtagtcggttactacgtcgtccttccgtccgtcctacgtaacgtcgtacgacaaccgtaccgccctaccctacactacttctactacgtacctacgcgtacgaggaacggaacgtacggtacctaggttaaacctttaagtttagttacacggtaacgtacccttacgtaaatttaacttaaaccggtagtaaaaccttacgtaagttaaacggtacttacccgtaaagttacggttacccggtttgggttaccgggacggggttaaacggaaaccgtttacgggtaccgttaaccggtacgttaccggaaccgtaaccggttaaaccccgg

SEQ ID NO: 388308 - DNA, 704 bp, Homo sapiens
  misc_feature: GZ8MTXP02IB1HN.39.39.D06.1.454.CMB.2.raw
  modified_base (373)..(373): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctccgtcggcggagatggaagtgggtggaggttcgggtccgccgacggccccccgaaggggaagggcgtggtaggttggagttggtagaaaataaagtaggaacggacccggggacaaccgaactaacaagtcgccgtacccgtacgagggtcgacgtcacctatactctgacagaacaagtaccaaacgaacctacttccnccgtagacggctcgacccctcgtcgtcgaccggccgacggtaccgtccggacctaagtaacttactttagttcgtagtcgtagtttagttttgacgtaaggtacgttcggtttagggggtaccggttagtacccggtacggttcggtagggggtaccgtaagggggtactacggtacggttacacgttccgtccgttccgactaccggtccccttacccgaaaccgaacggggtccccctaacggttcccggttccccgttccccgtcggcccgtcccgtcggtccctaccggaacgggtacccaccgaccgtaccgacggacgaccgacg

SEQ ID NO: 388309 - DNA, 669 bp, Homo sapiens
  misc_feature: GZ8MTXP02HRNHN.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttgtgtcttataattatgtctcctgttaccaacagctattcgaggcacgcccgaccccgtaaattctttaaatttagtgtacgttcgtttcgtcggtccctggttacgggttctagtcgtcttccgtacgtctcgtaagtctggaccctaaacgcccggtccttcccgacgaaccctacttcctacgttacgacccttaccgaacggtcgtaggacggaccggtacgtaccgttaggtaaacctttaatttacgtgggactacggtctacgttaataacttacgtagtaaaagtccgtaaagttcggtaaaccttccgacgtttacgggtaccgtttcggggttaccggaaccgggggtacggtaaacccgttaggggttttaacccaccccgggtttaccggtaacggtaccgttaaccggtaacccccgg

SEQ ID NO: 388310 - DNA, 579 bp, Homo sapiens
  misc_feature: GZ8MTXP02ISFUU.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttaccaacagcattcaggcagccgaccccgaaatcttaatttatgtagttctttcgtcgcctgtaggggtttctagtcgtcttcgtcccggtctcctaagttctacgggacctaaaccgccggtcccttacccgtgaccctatcgtctacgaccttccgaggtctaggaacggcgacgggctagtaaccttagtttatgactaagcctacaatacgtactagaactcaaagttcggtaactcctaacgtcgtacgtcggttaccggagggacggaaccttacggtaccgtaccgtcgttacggactacggacccg

SEQ ID NO: 388311 - DNA, 571 bp, Homo sapiens
  misc_feature: GZ8MTXP02I8UB8.39.39.D06.1.454.CMB.2.raw
  modified_base (228)..(228): a, c, t, g, unknown or other
  modified_base (266)..(266): a, c, t, g, unknown or other
  modified_base (300)..(300): a, c, t, g, unknown or other
  modified_base (373)..(373): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactgaaccngcagtgacgttgtgcttatattatgtctcctgtccaanagcatcagcagccgaccccgaaatcttaatttangtagttctttcgcgcctgtcgggtttcagtcgtcttcgtccggctccgaagtctggaccaacgacgccctccnaccctatccgtatacgactccgaggctaggaaggacgaggtctagtacttaattattgcaagtctactaataatacgtaagaaacgtcaaaagttcggtaacttccgaacggtcgtacgttcggtacccggggacggtaacgggtaaacccgttaaggttcgtaacccggttctaacggggtccaacggtaaccccgg

SEQ ID NO: 388312 - DNA, 571 bp, Homo sapiens
  misc_feature: GZ8MTXP02JXNNK.39.39.D06.1.454.CMB.2.raw
  modified_base (434)..(434): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaactagcattcaggcagcgccccgaaactcttaatttatgagttctttcgtcgccctgtacggggtttctagtcgcttcgtccgctccaagtctggcaacgcggcctccctgaccatctctagacctcaggctaggaggacaggctgaacttagttatgcagctanattactactagaagtcaaagttcggtaactccgtactcgggtctttcgggttaccgggaccgggtaacggggtaacccgtaaaagggtttccgaaacccgggtttacgaaccggggttcaaacccggtaacccccgg

SEQ ID NO: 388313 - DNA, 730 bp, Homo sapiens
  misc_feature: GZ8MTXP02H0P00.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtcctggcctgacacacgcctgcctccgtgtctgagactcctggacagtcgatcacctatctcctgcacgtacggaaccagcagtcggtaacggttggtagtacttaataattntcgtctccgtgtaccaatcgctatcgaggccacggaccccgtaaccccgtaaatttctttaaagtttataggttacggtttaccttccggtacccggccccgtttaggttaccggggttttcctacggttcgtaccgtttccgcccggttacctaccgtaagttccctacggggacccaaaccggtcccggtacccttcccgacgaccctacgttacgtaccctaaacgtcccttacccggagggttcgtaaggggaaaccgggacgtacggtaaccttacgggtaaaactttagtttaacgcggacttaaacgtccctaaaggtaacttacggtaaaccgttaggtaaaacctaacgttaaacgttcgggtacttacccgaggttcggtacgttcgggtaccgggaacggtacgtaaaccgtacgttaccggaccctaccggtaggcctaacggcccgg

SEQ ID NO: 388314 - DNA, 699 bp, Homo sapiens
  misc_feature: GZ8MTXP02JO43Y.39.39.D06.1.454.CMB.2.raw
  modified_base (218)..(218): a, c, t, g, unknown or other
  modified_base (229)..(229): a, c, t, g, unknown or other
  modified_base (273)..(273): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctncactggaaccngcagtgacgttggtgcttataattatgtctcctggttaccaacngcattcagcagcgaccccaaactcttaatttatgtaggttcttcgtcgtcctcgtacggggtttctagtcgtcttctcccggctccgtaagtctcggaccaacctacgggccctaccctcgacctagttccctctaacgacccttcgacggtcgtacggaaggaccggaaggtcctggtaaactttagtttaagtttcgacgtaacgtcccttaactaacggtttaacgtaactaacgggttaaaacggtactaaaaagttcgggttaaaacctttcccccgagtttacgggggtaccgtttcggggtttaaacccggggtaccgggggaacgggggttaaaaccccgttaaaacggggttttcccgggtaaacccccgggtttacccggtacggggttaaccccgaccgggtaaaaccccccggg

SEQ ID NO: 388315 - DNA, 632 bp, Homo sapiens
  misc_feature: GZ8MTXP02I7Z0U.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttaatattatgtctcctgtaccaacagcatcaggcagccgaccccgtaaattcttaatttatgtacgttctttcgtccggtcccttacgtacggggtttctagtcgtcctttccgtccggtctccgaacgttctcggacctaaccgaccggtcccttcccgtacgtaccctacgtcctacgtacgaccctaccgaggtcctaggacgggaccgagtccgtacgtaacttattacgttcgactacgtactctaattactaacgtagtaacgtactaagttacggtactaccgtacgtcggttacgttcgggttaccgggacggtaacgggtaaccgttaaggttaccggtacccggttaccgtacggtaccgtaaccggtaacccgg

SEQ ID NO: 388316 - DNA, 515 bp, Homo sapiens
  misc_feature: GZ8MTXP02I026O.39.39.D06.1.454.CMB.2.raw
  modified_base (229)..(229): a, c, t, g, unknown or other
  modified_base (388)..(388): a, c, t, g, unknown or other
  modified_base (411)..(411): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgcccccgaaaactcttaatttatgtagttctttcgtcggccctcgaggggtttctagtcgcttctccggctccaagtctggacaacacggcctccctgaccntctctacgactcagctgagacgngctgacttattattgctagctacatatactgaaatcaaattggtatccagtcggcttggttcggcggaggaaccgtaagttcgaccgtctacggtcacgacccg

SEQ ID NO: 388317 - DNA, 611 bp, Homo sapiens
  misc_feature: GZ8MTXP02FL2E9.39.39.D06.1.454.CMB.2.raw
  modified_base (230)..(230): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctcctgcactggaaccngcagtgacgttggtgcttataattatgtctcctggttccaacagcattcaggcacgccgaccccgtaaaacttcttaaatttatgtaggttctttcggtcgtccctcgtacggggtttctacgtcgtccttcgtcccggtctccaagtctggaccaacgaccggcccttccctgacctacttctactagaccctccaggtctggacgacgaggctgaacttattattcgctagcctacaattaactactagtaaacgtactaaagttcggtaaactccgtaacgttgggtaccgttcgggttaccggggacgggaaaccggggtaaccgtaaacggttccggtaacccggttaccgttacggaccgtacggtaacccccgg

SEQ ID NO: 388318 - DNA, 689 bp, Homo sapiens
  misc_feature: GZ8MTXP02HOWLT.39.39.D06.1.454.CMB.2.raw
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccacatctctgcactggaaccagcagtgacgttggtgcttataattatgtctcctggttccaacngctattcaggcagccgaccccgaaattcttaatttatggtacggttctttccgtccggtcccttacgtacggggttttccacggttcgtccttttcgtcccggctccgtaaagttcgttcggaccaaccgtaccgggtcccccttcccgtacgtacccctacttacccgttccgtaacgtacccttacccggtacgggtaccgtcgggtaaacggggacccggtacggggtaccttacgggtaaacctttaagtttttaacgttcgtaccgtaaggttcctacgttaataaactttacgtaggtaaacgtactaagttacggtaactccgtaacgtgggtaccgttcgggtaccgggtacggacgggtaacccgtaggttacggtacccgttacgtacggtaccgaacggtaccccgg

SEQ ID NO: 388319 - DNA, 645 bp, Homo sapiens
  misc_feature: GZ8MTXP02IOBNV.39.39.D06.1.454.CMB.2.raw
  modified_base (228)..(228): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataattatgtctcctggttaccaacagcattcaggcacgccgaccccgaaaacttctttaaatttatggtaggttctttccgtccggtccctcgtacggggtttctagttcgtctttcgtcccggtctcccgtaagttcctggaccaaaccgccggcccttccctgacccatcctactacgacctcccgaaggtcctaggacggaccgaggcttagtacttatttatgcacgctacaattataacgtagtaaagtctaaaagtttcggtaaacttcccgtaaacgttcgggtcctttacgggggttccggggaccggggtaaacggggtaaacccttaaaaggtttcccggtaaaccccggttccgttaacgggttacccgaaccggtaaacccccgg

SEQ ID NO: 388320 - DNA, 561 bp, Homo sapiens
  misc_feature: GZ8MTXP02JUVJG.39.39.D06.1.454.CMB.2.raw
  modified_base (358)..(358): a, c, t, g, unknown or other
  modified_base (469)..(469): a, c, t, g, unknown or other
  modified_base (535)..(535): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaagtggtggagttgggtccgccgacgcccccgagggaagggctggagttggattggtagaaataaatgaggaccgggggcaaccaactacaatgcgtccctcgaggggtcgagtcaccatatctgcagacaagtccaaagaacccacttcctccctgacggctgacccctntgtcgaccgccgcgactcggccatactattattgtgcgagtgttttgctaggatcgttggggcgtagtcgacgtcgtggggtcgaaggtatcgacggtcagtcgtctcctnacgcctccaccgacggcccagtcccggtccttccccgtcggccctcccgtcgccctccgaaggccnccgacccgtccgacgaccgcaaccgg

SEQ ID NO: 388321 - DNA, 647 bp, Homo sapiens
  misc_feature: GZ8MTXP02JTQB5.39.39.D06.1.454.CMB.2.raw
  modified_base (268)..(268): a, c, t, g, unknown or other
  modified_base (326)..(326): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatctcctgcactggaaccagcagtgacgttggtgtctatattatgtctcctgtccaangcattcaggcacgccgaccccgtaaactcttaattatgtagttctttcgtcgtccctntacggggtttctagtcgtcttcgtccggctccgtagtcgtcggtacaaccgaccggtccctccctagtacccattcctacgtacgaccttaccgagggtcctaggacgggtacgacgggtactacgtaacttacgttaacgttcgccgtaacgtctacgtaaattacgtaaccttaggtaaacgtcgtaaaacgttcgggttaaacttcccgaaacggtttcggtccgttacgggttaccggggacgggtaaccgggtaacccgtaacgggtttaccggtaaccccggttcgttaaccggggtaccaccggtaacccccgg

SEQ ID NO: 388322 - DNA, 741 bp, Homo sapiens
  misc_feature: GZ8MTXP02IGQ7Y.39.39.D06.1.454.CMB.2.raw
  modified_base (611)..(611): a, c, t, g, unknown or other
  modified_base (619)..(619): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatcctctgcacgtacgaacagcaggtgtacggttggtgtacttaagtaattatcgttccttaccgttacggttaccaaacgtagtacctactttacgaacgggaccaacggtacccccgtaacccccggtaaaactttaccttttaaaagttttagtcggttaacggtttccgtttaccggtccggtaccccttcggtttaacccggggttttcctaacggttcccgttccgtttccgtaccccgggtaccttaccgtaacgtttccggtacggacccctaaaccggtcccggtacccctttccccggaactaccctaccgttcttaccgtaaccgcccttacgaacggtcgtacgggaacggtacggaaagtcgtaacgttacttaagtttagttgacncgtactanaacttagtcgtaagaacgttacaaaagttctacttaccggatcgggtactcgggttaccgggaacggtacggggtaacttacggttcgacccggttacgttacgtaaccgccgtaacccggg

SEQ ID NO: 388323 - DNA, 643 bp, Homo sapiens
  misc_feature: GZ8MTXP02JEBHA.39.39.D06.1.454.CMB.2.raw
  modified_base (227)..(227): a, c, t, g, unknown or other
  modified_base (241)..(241): a, c, t, g, unknown or other
  modified_base (270)..(270): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaacngcagtgacgttggntcttataattatgtctcgtgttaccaacngctattcaggtcacgccgaccccgtaaaacttcttaaatttagtcggtacggtttccttttcggtaccggtcccttacggtacggggttttctacggtccgtcgttccgtcccggcttccgtaagttcgtacggacctaacgcccgtccctccctacgacctactctctacgaccgtccgaggctaggacggtacgcgtcctagtacttatttacgtgaccgagtctactaatacgtaactagtaagttacgaagtttacggtaccttacgacggttcggtacgttcggggttaccgggacggggtaaacggtaaccggtaacggtttccggaaacccgtttccggtaaacggtacccgacggtaacccccgg

SEQ ID NO: 388324 - DNA, 601 bp, Homo sapiens
  misc_feature: GZ8MTXP02JB92N.39.39.D06.1.454.CMB.2.raw
  modified_base (268)..(268): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactgaaccagcagtgacgttggtgcttataattatgtctcctgtaccaangcattcaggcagccgaccccgaaattcttaaatttgtggggttcctttccggtcgccccttagtaggggtttcctagtcgtccttcgtccggcttaccgtagtctcggcctaacaccggtccctcctcgacctatctctacgactccgagccgtaggacgtacgagctagtacttattattgacctagtcctactataagtactaagaacgtacgtaaattacgggtactaccgtacgtacggtcgttacggttccgggaaccggtacgggtaaccctaaggttcccgtaacccggttaccggtacggtaccgtaccggacccgtaaaccggg

SEQ ID NO: 388325 - DNA, 593 bp, Homo sapiens
  misc_feature: GZ8MTXP02JXWXN.39.39.D06.1.454.CMB.2.raw
  modified_base (314)..(314): a, c, t, g, unknown or other
  modified_base (364)..(364): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccagcagtgacgttggtgcttataattatgtctcctggttaccaacgagctattcaggcacgccgaccccgaaaattcttaaatttntgtacggttctttcgccgccttgtacggggtttctagtcgtcttcgccgntccagtctggacacgcgcctcctgacctatccgtactagacctccgagctaggacggacgaggctaggaacttattagtcgctagccttacgaattactacgtagtaaacgtacgtaaaagttcggtactacccgaaggttcggtaccgttcgggttacgggacgggtaacggggtaaccctaaggtttccggacccggttaccgtacgggtacccacggtaaccccgg

SEQ ID NO: 388326 - DNA, 688 bp, Homo sapiens
  misc_feature: GZ8MTXP02F7WLT.39.39.D06.1.454.CMB.2.raw
  modified_base (312)..(312): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatcctcctgcactggaaccagcagtgtacggttggggttatgactatgtctcgtggtaccagacaatactccaggcacacgaccccccaaatcatctatttangagtcagtaatccggcctccgtagggtttctaagtcgtcttctctcggcctacgaagttcctacggtacaaaccgaccgggtccctaccctcgaacctactcctcgtcgggtcctccgacggtcgtacggacggacgtacgggacttaggtaactttacttaacgtggacctaggtccttacgtaagtttacggactaacgttaccgtaacggttaggtaccggggttaccttttaaaggttcggttttacccccgggtttaaacggggtaaacggggttaaccgggggtaaaacccggttaaacggggtttaccgttaaaaccggtttccccgggttaacccgggtttacgggtttacccgtaaaaccccccggg

SEQ ID NO: 388327 - DNA, 610 bp, Homo sapiens
  misc_feature: GZ8MTXP02GSQ4G.39.39.D06.1.454.CMB.2.raw
  modified_base (229)..(229): a, c, t, g, unknown or other
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaanagcattcaggcagccgaccccgtaaattctttaatttatgtagttctttcgtccgcctgtacgggtttcagtccgtcttcgtccggtctcctaagtctacggaccaaaccgaccggtccccttccctagaccctacttctacttacgaccttcccgaggcttagggacggacgaggtctaggacttatttagtgactagctactaatatacgtagaaacgtactaagttaggtacttaccgtaacgttcggtcgtttcgggttaccgggacggggtaacggtaaccgtaacggtttaccggacccggttaccgtaacgggtacctaacggaacccccgg

SEQ ID NO: 388328 - DNA, 676 bp, Homo sapiens
  misc_feature: GZ8MTXP02HSNN4.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgtacttataattatgtccttccgtggttaccaacagcctattcgaggcacggacccgaacccccgtaaaacttctttaaaatttacgtaggtaacggtttcctttccggtccggtccccttacggttaaccgggggttttctacggttccgtcctttccgtccccgggtcttcccgtaaagttcccgtagggaccctaaaacgtcccgggtcccttacccgtcgaaccctattccctacgtacgtacccttaccgacggtctaggacgggacgaggtctagtactttaatttagtgacaacgtctactattacgtactagtaacgtactaaaagttggtaacctcgtaacggttcggtcgttacgggttcgggtaacgggacggtaacccgttaaggtccgtacccgtcgttaacggcgtaaccggtaacccgg

SEQ ID NO: 388329 - DNA, 706 bp, Homo sapiens
  misc_feature: GZ8MTXP02ISLXT.39.39.D06.1.454.CMB.2.raw
  modified_base (270)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttatattatgtctctgttaccaangctattcaggcacgccgaccccgtaaattcttaaatttagtaggtagttctttagtccggtacccttcggtacggggtttcctagttccgtcctttccgtcccggtctcccgtaaagttccgtacgggaccaaaccgtccgggtccccttcccgtacgaccctattcctaccgtaacgtaacccttccgaacggtcgtacggacgggacgtacggaccttaggtaccttaagtttagttcgactacgtcttactaactttaagtaccgttaggtaaacttaccggtaaaattcgggttaaacttccccggtaacgttacggggttccgtttacggggtttaccggggaacccgggtaaacggggttaacccgttaaagggtttacccggtaacccggttaccgtttaacgggaccgttaacccggtaaacccccgg

SEQ ID NO: 388330 - DNA, 674 bp, Homo sapiens
  misc_feature: GZ8MTXP02G7SZK.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatctctgcactggaaccagcagtgtacgttggtgacttatattatgtctctgttaccaacagacattcgagcgagaccgacccgtaaaattacttaaagtttatacggtacgttctttcggtaccggtccctcggtaacggggtttcctagttccgtcttccgtccggtactccgtaaagttcgtacggacaaacccggtccggtcccttacccgtacaaccctaacttcctacgttaacgacccttaccgaggtacctagggtaaggaccgaaggtactaccggtaaattacttttaaacggtacgtactacgtaccttaagtaattaacgtaacgttaagtaaacgtaacgtaaaacgttacggttaactaccgtacggttacggtcgttaccgggtacgggacgggtaaacggtaacgttaacggttaccgtaccggtacgtacgtaccgaacggacccg

SEQ ID NO: 388331 - DNA, 629 bp, Homo sapiens
  misc_feature: GZ8MTXP02IP9LU.39.39.D06.1.454.CMB.2.raw
  modified_base (230)..(230): a, c, t, g, unknown or other
  modified_base (245)..(245): a, c, t, g, unknown or other
  modified_base (255)..(255): a, c, t, g, unknown or other
  modified_base (269)..(269): a, c, t, g, unknown or other
  modified_base (304)..(304): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccngcagtgacgttggtntcttatattntgtctctgtaccangcatcagcacgcccgacccctaattacttaatttntggtagttccttcgtccgtcctcgtacggggtttctagtccgtcttccgtacccgtctccgtaagttccgtcggaccctaaccgaccggtcccctcccgtacgaccctacttacctacgtacgtacccgtccgacggtcgttacgggaacgggtacgacgggtcgttacgttaactttagtttagttcggactacgtccttactaattagtaactaggtaaaccgtataagtttacggtaacttccgacgttcgggtcgttcggtaccggggacggtacgggtaacctacggttcggacccgttacgtacggtccacgtacccgg

SEQ ID NO: 388332 - DNA, 691 bp, Homo sapiens
  misc_feature: GZ8MTXP02FT5JD.39.39.D06.1.454.CMB.2.raw
  modified_base (274)..(274): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcacctatcctcctgcactacggaaccagcagtgtacgttggtgcttataattatgtctctgtccaangctatcaggcacgccgacccccgtaaatttctttaaatttagtagtacggtttcctttccgtaccggtcccttaggtaacggggttttcctacggttcgtcctttccgtccggtcttcccgtaagttctacgggaccctaaccgtaccgggtccccttccccgtagaaccctacttccgtaaccgtacgacccgttacccgaagggtccttaacgggacggggtaaccgcgggtacctaggtaacctttagtttaacgtcgaaccgtagtccctaaactagttaacgttactaaggtaaactcgttaaaagtcggttaacttccgaacgtttgggcgtttacgggtacggggacggtaaacgggtaacccgttaggttaccggacccgtttacgacgggttaccaccggtaacccgg

SEQ ID NO: 388333 - DNA, 575 bp, Homo sapiens
  misc_feature: GZ8MTXP02G1Y7T.39.39.D06.1.454.CMB.2.raw
  modified_base (229)..(229): a, c, t, g, unknown or other
  modified_base (268)..(268): a, c, t, g, unknown or other
  modified_base (296)..(296): a, c, t, g, unknown or other
  modified_base (443)..(443): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatatatgtctctgtaccaacngcatcagcagcaccccgaatcttaattntgagttcttcgcgtcctgtcgggtttcagtcgtcttcgtccggctccgtagtcgtggaccaaaccgtccggccttaccctgaccctatcctctaacgcctacgaggtctagacgcgaggtctagacttattattcgacgtatacctnaattataaccgttagtaaacgtcgtaaaagttcggttactaccgacgttcggccgtttgggtaccggacggtaaacggggtaaccttaaggtttaccgacccgttacggtacggtacgaccggtaaccccgg

SEQ ID NO: 388334 - DNA, 767 bp, Homo sapiens
  misc_feature: GZ8MTXP02F0YUL.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcacctatctcctgcactcggaaccagcagtgacgttggtgtacttaataattatgtctcttacggttaccaacacgatattcaggtcacgcccgaaccccgtaaattactttaaactttagtaggtacggtttccgttttacggtccggtaccccgttacgggttacggggtttttaccttacggttccgttccgtttaccggtcccccggtacctttacccggaaacgtttccggtaccggggtaaccctaacccggtacccgggtccccttaccccgtacgtaaccccttaacttccgtaaccttacgtaacccttacccggacgggtactaggggaaacgggaacggaacgttccgtaacggtaactttaagtttaacgtcgtaccgtacgtaccctaagtaaactttaacggttactaaaggtaaacgttaactaaggttacggttaacctaccgtaacggttcggttccggttacggggtttaccggggacggggtaacggtaaaccggttaacggttcgtaaacccggtcggttaacggtccaacggtaaccccgg

SEQ ID NO: 388335 - DNA, 618 bp, Homo sapiens
  misc_feature: GZ8MTXP02HCB8N.39.39.D06.1.454.CMB.2.raw
  modified_base (183)..(183): a, c, t, g, unknown or other
  modified_base (244)..(244): a, c, t, g, unknown or other
  modified_base (255)..(255): a, c, t, g, unknown or other
  modified_base (274)..(274): a, c, t, g, unknown or other
  modified_base (318)..(318): a, c, t, g, unknown or other
  modified_base (519)..(519): a, c, t, g, unknown or other
  modified_base (577)..(577): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtntctgacgactcctggacagtcgatcacctatctctgcactcgaaccagcagtgacgttgtntacttatattntgtctccgtggtaccaacngctagtcgacgcacgcccgacccgtaaacttacttaatttacgngttacgttccgtttccgtaccggtccccgtttggaccggggttttctacgtcgttccgttaccgtccggtccttaccgaacggttcctacgggacctaacccgcccggtccctcccgtacgacctactcctaactacgtaccctacgacgtcgtacggacggacgcgtactagtaaacttatttacgtgacgtactcttanaattaactacgtaaggtaatacaagtttcggaacttacgagtcgtacgtggtaccggnggtaacggaacgtaggtccgacgtcgacgtaccacgaaccg

SEQ ID NO: 388336 - DNA, 729 bp, Homo sapiens
  misc_feature: GZ8MTXP02H5ZOK.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcaccatctcctgcacgtaggaaccagcagtgtacgttggtgtcttaataatttatgttccttccgtacggttacccaatagcctaagtttcgaaggccacggccccgtaccccgtaaaatttactttaaatttagtcggttagtttcctttacggtcccggtccttggtacggggttctacgtctcttccgtccgtcctcgtaacgttcgtcggtaccaaccgtaccggccctcccgtacgaacctcttccgtactacgtaccctccgtacggtcgtacgggaaacgggacgggtaacgtacgttacggttaaaccttaagttttaacgtcgaccggtaaccgtcgttaacgtaacgttataaaccggtttacggaaaattaaccgttaaaaggttcggttaacccttacccgtacgtttgggtccgtttacggggtccggttaaccggggaacgggtaacccgttacgggttacccggtaacccggtacgggtaaccggttacccggaaaccgtaccccgggg

SEQ ID NO: 388337 - DNA, 555 bp, Homo sapiens
  misc_feature: GZ8MTXP02JQJC0.39.39.D06.1.454.CMB.2.raw
  modified_base (229)..(229): a, c, t, g, unknown or other
  modified_base (349)..(349): a, c, t, g, unknown or other
  modified_base (389)..(389): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcaaggggcacagggtcctgggcccagtctggcctgacacagcctgcctccgtgctgagactcctggacagtcgatcacctatctctgcactggaaccngcagtgacgttggtgcttatacttatgtctctggttccaactagcattcaggcagcaccccgaaactcttaaatttactgagttctttcgtcgtcctcacggggtttctagtcgtcttcnccggcttccgaaagtctggccaacgcgcctcctgaacccntctactacgactacacggctagacgacgacgcgtcgtactacttatacgtacacgtctactactactactagtaacgtactaacgtacgtacgtacgtacgtacgtacgtacgttacggacggacggtaacgtaacgtacgtaccgtacgtacgtacgtacgaccg

SEQ ID NO: 388338 - DNA, 672 bp, Homo sapiens
  misc_feature: GZ8MTXP02GSA36.39.39.D06.1.454.CMB.2.raw
  modified_base (445)..(445): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctcccgtcggcggagatgaagtgggtggtaggttcgggtccgccgacggcccccgaaggggaaggggctggaggttggagttggtagaaaataagtggaacggaccggggacaaccaactacaatgccgtcccgtgacggggtcgacgtcaaccattactcgtcgacaagaacaacgtaccaaacgaaccctacttcctcccgtgacgctcgacccctcgtgcgaccgcgcggacgtcggcctaatattattagtgtgacgtagttagttttgngtaggtcttgggttgggtacggtgtcggtacggttaggtggggtaacgaagggtacgtcgtacggtactacgttccgtccgttacctccgtaccgtccccgtacccgaaacccggaccgggtcccctaacggttccccgttccccgttcccccggtcggtcccccgtcccgtccgccgtacccggaacggtccgacccgtaccgtacccggagccgaccgaacccgg

SEQ ID NO: 388339 - DNA, 700 bp, Homo sapiens
  misc_feature: GZ8MTXP02HD321.39.39.D06.1.454.CMB.2.raw
  modified_base (246)..(246): a, c, t, g, unknown or other
  modified_base (258)..(258): a, c, t, g, unknown or other
  modified_base (277)..(277): a, c, t, g, unknown or other
  modified_base (509)..(509): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatcctctgcactggaaccagcagtcgtacggttggtnacttaataattntcgtctcctagtaccaacngctatcaggcacgcccgtaaccccgaaaatttacttaaagtttacgtcggttacggttcctttccgggacccggtccccgttaggttaccgggggttttcctaggttcccgtcctttaccggccccggtacttaccgtaaacggttcgacggaacccaaaccggtcccgccccttcccgactaccctacttctaccgtacgtaccctccgaaggcgtaacggaagggaccgnggtacctagtaactttaagtttcgtacggacctacgtccctaacgtaataaacgtacgtaagtaaaacgtaccgtaaaagttcgtaactcccgtaaggtcggtaacgttcgggttacgggaccgggtaaacgggtaaccgtaacgggttacccgacccggttacgtaccgggtacctaaccggtaacccgg

SEQ ID NO: 388340 - DNA, 699 bp, Homo sapiens
  misc_feature: GZ8MTXP02HXNQO.39.39.D06.1.454.CMB.2.raw
  modified_base (229)..(229): a, c, t, g, unknown or other
  modified_base (244)..(244): a, c, t, g, unknown or other
  modified_base (272)..(272): a, c, t, g, unknown or other
  modified_base (394)..(394): a, c, t, g, unknown or other
  modified_base (493)..(493): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacactctcctgcactggaaccngcagtgacgttggtntacttataattatgtctcgtgtccaaangctatcaggcacggacccgacccctaaattctttaattactggtacgtttcgtttacgtccggccttagttcggggtttctacgttccgtcctttacgtcccggtcttccgtaaacggttcncgggtaacccaacgcccggtcccttaccccgagtaaaccctcggttccttacgtaaccgtccgttaccccgagggttactagggacgggttaacccggnggtaccgttaacgtaactttaggttacttcggtactaacgttctaacgttaacttaaacgtaacgttaacggtaaactacgttaaacggtacggtttaactacccgtacggtcgggttacgttaccgggggttacgggaaccgggaaccggttaaccggttaacgttaccgggtaccgttacgttaacggcccgtaaacggtaccg

SEQ ID NO: 388341 - DNA, 768 bp, Homo sapiens
  misc_feature: GZ8MTXP02IA6T5.39.39.D06.1.454.CMB.2.raw
  modified_base (228)..(228): a, c, t, g, unknown or other
  modified_base (244)..(244): a, c, t, g, unknown or other
  modified_base (272)..(272): a, c, t, g, unknown or other
  modified_base (313)..(313): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctctgcactggaaccngcagtgtacgttggtncttataattatgtctctggttaccaacngctattcaggcacgccgaccccgtaaattcttaaatttagnggtacgttctttccgtccggtccctggtacggggtttctacgtccgtctttccgtccggtctcccgtaagttccgtaggaccctaaaccgcccggtccctccccgtagtacccattccctacgtacgacccttcccgacgggtcttacgggaacgggtacgtacgggtaccgttacggttaaaccgtttaaattttcgtttaccggaccgtaacggttaccccttaattaaactttaacgttaaaaccggtagtaaaacgggtttaaaccctaaaagggtttacggtttaaccctacccttaaacgggttccggggtaccgttttccgggggttaaccgggggcccgggggttaaaacggggtaaaacccggtttaaacgggggtttacccggttaaacccccggggtttaccggtttaacgggggtaacctaacccggggtaaaccccccgggg

SEQ ID NO: 388342 - DNA, 653 bp, Homo sapiens
  misc_feature: GZ8MTXP02J3O43.39.39.D06.1.454.CMB.2.raw
  modified_base (230)..(230): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccaggtctggcctgacacagcctgcctccgtgtctgagactcctggacagtcgatcaccatctcctgcactggaaccngcagtgacgttggtgcttataattatgtctccgtggttaccaagagtctattcagggcacgaccgaccccgtaaaacttctttaaatttagtgtaacggttcctttccggtccggtccccttacggtacggggttttacctaggttccgtctttccgtcccggctcccgaagtccgtaggaccaaaccgccggtccctacccgtcgaaccctatacctaccgttacgaccctcggaaggctaggaacgggtacgacgggtaccttcgaaacttagttacgttgacctaacgtctacctaatactacgtagtaatacaagttacgttacacccgtgtacggtcttcgggtaccggtaacgggtaacggtaacccgtaaaacggttccgaaccggttaccgttacggaccctaacggtaaccccg

SEQ ID NO: 388343 - DNA, 767 bp, Homo sapiens
  misc_feature: GZ8MTXP02G21IX.39.39.D06.1.454.CMB.2.raw
  modified_base (543)..(543): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgagacctcctggacagtcgatcaccatctcctgcactggaaccagcagtgacggttggtgtcttaataattatcgttccttccgtggttacccaacgtgtacctattcgacggtcgacggccccgtaaccccgtaaaactttacttaaaattttacgtaggttacggtttcctttccggtccggtaccccgtttagggttaaccggggttttcctacgttccgttcctttccgttccccggtcttacccgtaagttccgtacggaccctaaaccgtacccggtcccttccctacgacccttaacttcccgtacgtaacgtacccttccggaagtcgtaacgggaacgggtaaccgnggtccttaacggtaacctttagtttcgtacggcctaaacgtcccttaataaacgttaacgttaacccgtaaggtaaacgttacccgtaaaagtttcggggttaaacctaccggttaacggttcggggtaccgttttaccgggggtacgggaaccggggtacggtaaccgttaaacggttccggtaccccggttacgtacgggtacccgaaccggtaaccccggg

SEQ ID NO: 388344 - DNA, 653 bp, Homo sapiens
  misc_feature: GZ8MTXP02HYDU0.39.39.D06.1.454.CMB.2.raw
  modified_base (245)..(245): a, c, t, g, unknown or other
  modified_base (271)..(271): a, c, t, g, unknown or other
  modified_base (475)..(475): a, c, t, g, unknown or other
  modified_base (498)..(498): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtcctggcctgacacagcctgcctccgtgtctgagactcctggacagtcgatcaccatctcctgcactggaaccagcagtgacgttggtncttaataattatgtctctgttccaanagcatcagcacgccgaccccgtaaatcgttaatttagtgttagttccgtttacgtccggtccttagtaccgggtttctacgtcgtcttcgtccggtcctccgaacgttcgtacggacctaaaccgcccgggtcccttcccgtacgtaaaccctacgttccctctaaccgtaccttacccgaaggtcctagggacgggtaacggngtactacggtactttaagtttcncgtactacgtcctataacttaagtacgttaagtaaactaacgtaaacgttacggtacctaccgtacggtcggtcgttcgggtaccggggtacgggtaaccggtaaccgtacggttacccggtacccggtacggtacggtaccgaaccggtacccg

SEQ ID NO: 388345 - DNA, 637 bp, Homo sapiens
  misc_feature: GZ8MTXP02GAGXO.39.39.D06.1.454.CMB.2.raw
  modified_base (224)..(224): a, c, t, g, unknown or other
  modified_base (237)..(237): a, c, t, g, unknown or other
  modified_base (262)..(262): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcatcacatctctgcactgaaccngcagtgacgtgtntctataattatgttcctagtccaangctattcagcacgaaaccgcccgtaaaatctttaaatttagtagtacggttctttaccggtcgtaccctacggtaggggtttccctacggtccgtcgttccgtccggtccttaccgtaggttcctgggacctaaaccgcccggtccctacccgtagtaccctattcccgtactaacgactaccgaggcctaaggaacgggacgacggtcttaaacggtacttaagttagttcgactacgtccttaacaagttaacgtactaaggtaaatacgtaaaagttcggttaaactccgtaaggtcgtcgttacgggtcgggacggtacgggtaactaaggtttaccgaccgtttacgtaggaccaacgtacccggaacgg

SEQ ID NO: 388346 - DNA, 554 bp, Homo sapiens
  misc_feature: GZ8MTXP02FHAYJ.39.39.D06.1.454.CMB.2.raw
  modified_base (309)..(309): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcaggtgacgttggtgtctaataattatgtctcctggttaccaacagcattcaggcagccgaccccgaaatcttaattangagttctttcgcgtcctgtacgggtttctagtcgtcttcgccggctccaagtctggacaactacggcccttccctgacctatcctctacgactcccaggctaggaggacgagctagacttattattgcagctacatatacagaaatcaaatcggtaactcctaacgtggtcgtcggttacggcgggtaacgggaaacccgtaaggttaccgacccggttaccgtaacggtaccgacggtaccccg

SEQ ID NO: 388347 - DNA, 718 bp, Homo sapiens
  misc_feature: GZ8MTXP02F2AIK.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccagcagtgacgttggtgcttataattatgtctctgttaccaacagcattcaggcacgccgaccccgtaaattcttaatttatgtaggttctttcgcgtcccttgtacgggtttctagtcgtccttcgtcccggtctccgaagtccgtggaccaaccgaccggcccttaccctacgaccctacttcctactaacgacccttacccgacgggtacttacgggaacgggtaccgaggtaccgttacggtaaacctttaattttagttaccgaccgtaacgtacccttacctaaatttaacgttaaaccgttaggtaaaaccggttaacctaaaaggtttacggggttaaacttacccggtaaacgtttcggggtaccgtttacgggggtttacccgggggaacgggtaaaccggggtaaacccgttaaaacggggtttcccggtaaaaccccggtttccgttaaacggggttacccaaaccgggtaaacccccgg

SEQ ID NO: 388348 - DNA, 561 bp, Homo sapiens
  misc_feature: GZ8MTXP02JYRKN.39.39.D06.1.454.CMB.2.raw
  modified_base (231)..(231): a, c, t, g, unknown or other
  modified_base (272)..(272): a, c, t, g, unknown or other
  modified_base (345)..(345): a, c, t, g, unknown or other
  modified_base (357)..(357): a, c, t, g, unknown or other
  modified_base (381)..(381): a, c, t, g, unknown or other
tcagtcgcactagtcacgaccggtgctcgatttagtgacatctcgcagttctttggggggggtctcaggaggcagcgctctcagaacatctccaccatggcctgggctctgctgctcctcaccctcctcactcagggcacagggtcctgggcccagtctggcctgacacagcctgcctccgtgtctgagactcctggacagtcgatcaaccatcctcctgcactggaaccngcaggtgacgttggtgtcttataattatgtctctgtcaacngcattcagcagccgaccccgtaaactcttaattatgtagttcttcgtcgcctgtacgggttctagtctcttcnccggctcagtcngacacacgcctcctcgactatctntacgactcgacggctaggacgacgaggctacgacttattagtcgctagcctatacttaatacgtagaaactagaacgtcggtaatccgtaacgtcggtcgttcggttaccggggacggtaacggggtaacctaaggggttaccgtacccggtacgttacccgggtcaaccggtaacccgg

SEQ ID NO: 388349 - DNA, 607 bp, Homo sapiens
  misc_feature: GZ8MTXP02JQF1I.39.39.D06.1.454.CMB.2.raw
  modified_base (217)..(217): a, c, t, g, unknown or other
  modified_base (229)..(229): a, c, t, g, unknown or other
  modified_base (244)..(244): a, c, t, g, unknown or other
  modified_base (272)..(272): a, c, t, g, unknown or other
  modified_base (480)..(480): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcngcactggaaccngcagtgacgttggtncttataattatcgtctcctggttacaangtcaatttcaggtcacggcctaccccgtaaattctttaaatttatggtacgttctttcgtccggccctgtacgggtttctacgtccgtcttacgtcccggacttccgagttctaggacccaaccgtcggcccttccgtgaccctacgttctactagtccacgacggcctaggacgacggtacgtctagtattacgtttatgaccgtancttacaattactagtagaacttacaagttggtaaccttcgtacggtcgtacgttacgggttaaccgggcggttaacggggaaccctaggttaccgaacccgttcgttaacggcccacgggtaacccg

SEQ ID NO: 388350 - DNA, 760 bp, Homo sapiens
  misc_feature: GZ8MTXP02HYYCY.39.39.D06.1.454.CMB.2.raw
  modified_base (216)..(216): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcatatctctncactaggaaccagcgagtcgtacggttggtgtacttaataattatcgtccttccgtaggtaccactagctattcgaggcacggacccgtaaccccgtaaactttactttaaagtttatcggttaacggtttccctttaccggtcccggtcccttacggttaccggggttttctacgttccgttccgtttaccgtcccgggtacccttccgtaaacggttccgtacggtaccccgaaacccgtccccggtcccttaccccgtacgaccctagttcccttacgtaacgtaccccgttacgacggtaccgtaggaaaccgggtacgaacgggtacttacggtaaaccttttaaagttttacgttaccggagtaacccgtactttacctaaacgtttaactaaaccgtaggtaaacgtttacgtaaaggtttaacggtaccttacccggtacgtcgggttaccggtacggggttaccgggacgggtaaccgggaaccgttaacggtaccggtaccccgtttacggacggtaccgtaaccggaacccgg

SEQ ID NO: 388351 - DNA, 634 bp, Homo sapiens
  misc_feature: GZ8MTXP02JNN3R.39.39.D06.1.454.CMB.2.raw
  modified_base (229)..(229): a, c, t, g, unknown or other
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaanagcattcaggcagcgaccccgaaaatcttaatttatgtagtctttcgtccgtcctcgtacggggtttctagtcgtcttcgccggctccgaagttccgtggacaacgccggtccctccctacgacccattccgtactaacgtacctcccaaggcttaggaacggtacgacggtctaggtaacttattaagtttcgacgtacgtctacctaattactaacgttagaaacgttacaaaagttcggttaactcccgtaaacgttcggtacgtttcggttaccggggtaaccgggaacggggtaaacccgtaaaagggtttccggaacccggttaccgttaacgggtacccgaacggtaaacccccgg

SEQ ID NO: 388352 - DNA, 589 bp, Homo sapiens
  misc_feature: GZ8MTXP02IUDFF.39.39.D06.1.454.CMB.2.raw
  modified_base (226)..(226): a, c, t, g, unknown or other
  modified_base (253)..(253): a, c, t, g, unknown or other
  modified_base (269)..(269): a, c, t, g, unknown or other
  modified_base (437)..(437): a, c, t, g, unknown or other
  modified_base (453)..(453): a, c, t, g, unknown or other
  modified_base (456)..(456): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactgaacngcagtgacgttgtgtcttataattatntctcctggttccaacngactattacaggcacgccgaccccgtaaaattcctttaaatttatgtagttcctttcgtccggtccctcgtacgggtttctagtcgtctttcgtccgctccaagttctacgcaaccaccggccttcccgagacctatctctacgacctcgacgctaggaacgcgacgntacgtacttaagtttntancgactactctaattactaacgttagaagttacaaacgttggtaaaacctcgtaaacgttggtcgtttacgggtccggaacgggacggtaaccgtaaggttacgacccgtacgttacggcttaaccggacccgg

SEQ ID NO: 388353 - DNA, 534 bp, Homo sapiens
  misc_feature: GZ8MTXP02GP6H8.39.39.D06.1.454.CMB.2.raw
  modified_base (228)..(228): a, c, t, g, unknown or other
  modified_base (267)..(267): a, c, t, g, unknown or other
  modified_base (269)..(269): a, c, t, g, unknown or other
  modified_base (355)..(355): a, c, t, g, unknown or other
  modified_base (425)..(425): a, c, t, g, unknown or other
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctctgcactggaaccngcagtgacgttggtgcttataattatgtctctgtccaangnatcagcagcgacccgaatcttaattatgagttcttcgcgtcctgtagggtttcagtcgcttcgtccgctccaagtctcggcaaccncggcctccctagaccctatcctactacgaccttccgacggtcgtagacggacgacggctagacttatttntagacctagctacataatacgtagaagtactaatcggtactactacgtggcttcggtacggcggaacggaacctaaggttcgtacgtcgttaacggcgtaacggacccg

SEQ ID NO: 388354 - DNA, 575 bp, Homo sapiens
  misc_feature: GZ8MTXP02FMV1A.39.39.D06.1.454.CMB.2.raw
  modified_base (452)..(452): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgtccaacagcattcaggcagccgaccccgaaacttcttaatttatgtaggttctttaccgtcggtcccctcgtacggggtttctagtcgtcttcgtccggctccaagtctggcaacacggccctccctgacccatctactagacctccaggtctaggacgggacgaggctagacttattattgcagcctanattatactagaaagtcaaagttcggtaactcccaacgtcgggtacttcgggttacgggacgggtaacggggtaaccgtaaaaggtttcggaacccgttcgtaacgggtaccacggaaccccgg

SEQ ID NO: 388355 - DNA, 615 bp, Homo sapiens
  misc_feature: GZ8MTXP02JKZPQ.39.39.D06.1.454.CMB.2.raw
  modified_base (229)..(229): a, c, t, g, unknown or other
  modified_base (244)..(244): a, c, t, g, unknown or other
  modified_base (249)..(249): a, c, t, g, unknown or other
  modified_base (254)..(254): a, c, t, g, unknown or other
  modified_base (256)..(256): a, c, t, g, unknown or other
  modified_base (267)..(267): a, c, t, g, unknown or other
  modified_base (358)..(358): a, c, t, g, unknown or other
  modified_base (481)..(481): a, c, t, g, unknown or other
  modified_base (500)..(500): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctcgcctccgtgtctgagactcctggacagtcatcaccatctcctgcactggaaccngcagtgacgttggtncttanaattntntctctgtccangcatcagcacgcgacccaatcttattatgtacgttcttcgcgtccttgtacgggtttctagtccgtcttcgtaccgtctccgtaagttccncgggacccacgtacccggtccctcccgtacgacctcgttcctacgtacgaccctaccgcggtacttagggacgggacggaacgtccgtacgtaaacttaggttattacggacacggtaccttntaaacgttataaaccggtntaaacgtataaggttacggtaactccggtaacggttggtaccgttcgggttaccgggaccgggaacggtaaccgtacggttaccgtaccggtccgttaggacctaccggacccgg

SEQ ID NO: 388356 - DNA, 744 bp, Homo sapiens
  misc_feature: GZ8MTXP02G1I94.39.39.D06.1.454.CMB.2.raw
  modified_base (622)..(622): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcacctatctcctgcactgaaccagcagtgacggttggggtactgactatcgtctctacggtaaccaaactaactactccaaggaccaaccaaccgtaccccccaaaatacctaataccttaattttacgagtaacggttaccgaaagttaaacgtcccggtaccccttacggtaaccgggggtttttacctaaacgttccgtccgtttccgtccgttgggtccctaccgtaaacggttccgttacgggacccaaaaccggtacccgggtcccccttacccccgtacgtaaaacccctacgttacccgttcccggttacgggggacccctttaccccggaacgggttacccgtagggaaaccgggggaaccggtaaacggggccttaaggttaaactttaccgttaacgtcgtaacncggttacctcgtaatttacgactaatactaggtgaacgttcttaagtcgttaacgttcggaaacggtggtaaaccgaagggtttacacggtttacctacgttaacggtacacgtaaaccccg

SEQ ID NO: 388357 - DNA, 643 bp, Homo sapiens
  misc_feature: GZ8MTXP02FTMLD.39.39.D06.1.454.CMB.2.raw
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctcccgtcggcggagatgaagtggtggagttgggtccgccacgcccccgagggaacgggctgagttggattggtagaaataaagtggaggaccggggacaaccaaactacaagtgccgtccctcgaggggtcgacgtccaccatactctgacaagaaccaagtaccaaacgaaaccctacttcctacccgtgaggtctcgacccctcgtcgtcgacccggccgaccggacgtccggaccaatacttattagttgtgcgtagtgttttgcgtagtagttcggtgggcgttagtcgtacgtggtcgggtacgaaaggtacgtaccgacgtctacgttcgtcctccgtcgacgtccctaccgaaccgtaaccgggcccctaacggtccccggttcccttcccccggtcggtcccgtccccgtcgtcccgtccggaaccggtcgacccgtaacccgcggaacgtacgaccgaaccgg

SEQ ID NO: 388358 - DNA, 640 bp, Homo sapiens
  misc_feature: GZ8MTXP02I9C0U.39.39.D06.1.454.CMB.2.raw
  modified_base (205)..(205): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcggccaggagtggtgaagccttcggagaccctgtccctcacctgcgctgtgtctggagcctccgtcggcggagatgaatggtggagttcgggtccnccgacgccccgagggaagggctgagttggagttggtagaaataaatggaacggaccggggacaaccgaactacaagtcgccgtccctacgagggtcgagtaccaacctatatctagactacgaacaagtaccaaaagaaaccctacttactccctagacggtctacgacccctcgtgtacgaccgcggacgactcacgacctaagtactattattgtgacgtagttagttttgcgtaggttcgtcgttcgggggtacgttacgtcgaacggtcggttaggggtacggaaagggtacgtcgacggtactaacgtccgtcctccgtacgaccgcccctaccgaaccggaaccggccctacgtcccggtccccttccccgcggccctcccgtcgccgtaaccgacggtaccacccgtaaccgccgaacgacgaacccg

SEQ ID NO: 388359 - DNA, 758 bp, Homo sapiens
  misc_feature: GZ8MTXP02GWNCI.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgtcttataattatgtctcctgtaccaacagctattcaggcacgaccgaccccgtaaacttactttaaatttagtaggtacggtttccttttccggtccggtccccgttcggttaaccggggttttctacggttccgtccgtttcccgtcccgggttacttcccgtaaacgttcgttacgggaccctaaaccgtacccggtccccttacccgtacgtaccctacttcctaccgtacgtacccttacccgaacgggtccgtacgggaaaccgggacgtaacgggtaccgttacggttaaacctttaagttttacgttacggaccgtaacggtacccttacgtaaatttaaacgttaaaccgttaaggtaaaacgtacgtaaaacgttacgggttaaccttacccgtaacgttcgggtacggtttcgggttaccggggaaccggggtaaacgggtaaccgttaaacggttaccggtaacccggttaccgtttaacggtacccgtaaccggtaaccccgg

SEQ ID NO: 388360 - DNA, 619 bp, Homo sapiens
  misc_feature: GZ8MTXP02INCUR.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttaataattatgtctcctgttaccaacagcattcaggcagccgaccccgaaattcttaatttatgtagttcttcgtccgcctcgtacggggtttctagtcgtctttctccggtctccgtaagttccgtcggacctaaccgaccggtcccttcccgtacgtacccacttcctacgtactaccgtccgaggctaggaacgggacgaggcttagtacttatttatcgctaacgcttacatatacagtacgtacaagttcggtaactccgaacgttggtctttcgggttaccggggacggtaacggggttaaccgaaaacgggtttccggtaaacccggttaccgtttaaacggggtcctaaccgggtaacccccgg

SEQ ID NO: 388361 - DNA, 613 bp, Homo sapiens
  misc_feature: GZ8MTXP02IMVF1.39.39.D06.1.454.CMB.2.raw
  modified_base (316)..(316): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctccctcggcggagatggaagtgggtggagttcgggtccgccgacgccccccgaggggaacggggctggagttggattggtagtaaataaagtggaggaccggggcaccgaactacaatgcgtccctgagggtcgagtcacatanctgcagacaagtccaaagaacccacgttcctccgtagacgctacggaccctcgtgtacgaccgccgacgactcggcctagtattattagttgtcgcgtagttgttttgcgtaggtatcggttggggcgttagtcgtacgtgtggggacagggatcgacggtcagtccgtctctacgacgtccctacgaccgacgggtccctacggttcccgtccccttcccccggcggtccctccccgtcgtcccgtaccgaacggggacctaccgtaccccgtacggacgtacgacccgtaaccgg

SEQ ID NO: 388362 - DNA, 574 bp, Homo sapiens
  misc_feature: GZ8MTXP02I7D9D.39.39.D06.1.454.CMB.2.raw
  modified_base (273)..(273): a, c, t, g, unknown or other
  modified_base (338)..(338): a, c, t, g, unknown or other
  modified_base (420)..(420): a, c, t, g, unknown or other
tcagtcgcactagtcacgaccggtgctcgatttagtgacatctcgcagtttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttatattatgtctcctagttaccaanagcattcaggcagccgaccccaaattcttaaatttatgtagtctttcgtcgcctgtagggtttcngtcgcttcgcccgctccgaatctgacaacgtaccggcctccctacgactactctactagactcgagctagaggacgagcgtntaacgttatttagtcgacaagtctactaatataacgtagtaagtactaaagttcgtaacttaccgtaacggttgtacgttcggttacgggaccggggaacgggtaacccgtaaaggttcgaacccgttacgtacggtaccgtaacgaaccccgg

SEQ ID NO: 388363 - DNA, 626 bp, Homo sapiens
  misc_feature: GZ8MTXP02JKVSJ.39.39.D06.1.454.CMB.2.raw
  modified_base (273)..(273): a, c, t, g, unknown or other
  modified_base (442)..(442): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctggtaccaacngcattcaggcagccgaccccgtaaacttcttaatttatgtaggttcctttcgtccggccttgtaccggggtttctacgtcgtcttcgtccggctccgtagtcgtcggaccaacgaccgccctccctacgacctctccgtactacgtacctcgacggtctagagggacgngtcgacgtacttagttattgactagtctacgtaacttaagtactagaaacgtacgaaacgttacggttaactccgtaacgttgggtccgttacgggtttccggggtaacgggtacggggtaacccggtaaaggtttaccggaccccggttaccggtaacggttacccgaccggtaacccccggg

SEQ ID NO: 388364 - DNA, 759 bp, Homo sapiens
  misc_feature: GZ8MTXP02GA604.39.39.D06.1.454.CMB.2.raw
  modified_base (274)..(274): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacgagggtcctgggcccagtctggcctgacacagcctgcctccgtgtctgagactcctggacagtcgatcaccatcctcctgcactggaaccagcagtgacgtggtgtcttataattatgtctccgtgttaccaacngcattcaggcacgcccgaaccccgtaaattcttaatttagtgtacggttctttccggtccggtacccttcggtacggggtttcctacggttccgtccgtttccgtaccccggtctcccgtaaagttccgttacgggacctaacccgaccgggtcccctcccgtacgaaccctaacttcccgttactaacgacccttacccggaggtacgttacggggaacggacgtacgggtaccgttacggaaaccttttaagttaacgtttggaccccgttaaagtcccttaacgtaacttaaccgttaaccggttaaggtaaacggtacccttaaaaggtttcggggttaaccttacccggtaacggtttccgggtaacgtttcgggggttacccggggaaccgggggttaacgggaaacccgttaacgggtttacccggtaaaccccggttaccggtttaacgggacccggttaacccggtaacccccggg

SEQ ID NO: 388365 - DNA, 900 bp, Homo sapiens
  misc_feature: GZ8MTXP02H9SU3.39.39.D06.1.454.CMB.2.raw
  modified_base (229)..(229): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtccgtgggcccagtctggcctgacacagcctgcctccgtgtctgagactcctggacagtcgatcaccatctctgcactggaaccngacagtgacgttggtgtacttaataattatcgttaccttcctacggttacccaaacgtaacgctaacgtttacgacgggaccacggacccgtaacccccgtaaaacttactttaaactttaacgtggttaacgggtttcccgttttaccggtccccggtaccccgtttacggtaaccggggtttttcctacggttcccggttcctttaccccggttcccgggtacccttaccccggtaaagttcccgtaacggggtacccctaaaaccgtcccggggtacccccttcccccgtaacgtaaccccttaaacttcccttaaccgtaacccggaaaccccgttccccggaaaggggtacccgttaaggggaaccggggtaaaccggaaacgggggtcccctttaaacgggtaaaacctttaaacggtttaaagtttaccgggtcccaaaaggttccccgttaacgtaaacgtttaattaaacccggttaaggtaaaaccgttaataaacgtttacggggtaaacttcccgttaaaccggttcgggtttacccggttaggggttaaacccgggggtcccggggaaaacgggggttaaaccccaaaaggggtttttaccccggaaaccccggggtttacgttaaccggggtaaccctaacccgggtaaacccccgg

SEQ ID NO: 388366 - DNA, 639 bp, Homo sapiens
  misc_feature: GZ8MTXP02IQS0R.39.39.D06.1.454.CMB.2.raw
  modified_base (228)..(228): a, c, t, g, unknown or other
  modified_base (415)..(415): a, c, t, g, unknown or other
  modified_base (453)..(453): a, c, t, g, unknown or other
  modified_base (480)..(480): a, c, t, g, unknown or other
  modified_base (513)..(513): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctctgcactcggaaccngcaggtgtacggttggtgtcttaataattatcgtcttcctcggttaccaacagctattcaggcacgccgacccccgtaaacttctttaaatttataggtacggttcctttaccggtccgtcccgttcgtacggggttttctacgtcgtcttccgtcccgctccgagtctggccaaccgcgcctccgnaccatctacagtacctacgacggtctaggacgggacgnggacctaggtaaaccttatttacgtcnctaacgtctactaatagttaactgtaaaacgtntaaaacgtttcggtaactacctacggtttacggcgtttacggggttacccgggacggggtaacgggtaaccgtaacggttacccggttaacccggtccgttaacggtaccgtaccggaaaccccgg

SEQ ID NO: 388367 - DNA, 586 bp, Homo sapiens
  misc_feature: GZ8MTXP02FVV0X.39.39.D06.1.454.CMB.2.raw
  modified_base (227)..(227): a, c, t, g, unknown or other
  modified_base (241)..(241): a, c, t, g, unknown or other
  modified_base (249)..(249): a, c, t, g, unknown or other
  modified_base (261)..(262): a, c, t, g, unknown or other
  modified_base (266)..(266): a, c, t, g, unknown or other
  modified_base (287)..(287): a, c, t, g, unknown or other
  modified_base (415)..(415): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatccacatctctgcactggaaccngcagtgacgttgtncttatatntgtctctgtcanncatnagcagcacccaatcttaattngagttcttcgcgcctgtacggttctagtcgtcttcgccgctccgagtctggaccaacgtaccggtccctacccgtacgaccctattcctaactacgtaaccctccgaggtcctagggacggaaccggngtacgtcgtaacttagttgtcgacgtagacctactaattacgtaacgtagtaaagttacgtaagttacggtactaccgacgttcggtacgttacgggtaccgggacggtaaacggtaacgttaacggttacccgtacccggttaccgtaacggtacccgaacggtaacccg

SEQ ID NO: 388368 - DNA, 646 bp, Homo sapiens
  misc_feature: GZ8MTXP02IKE2C.39.39.D06.1.454.CMB.2.raw
  modified_base (200)..(200): a, c, t, g, unknown or other
  modified_base (226)..(226): a, c, t, g, unknown or other
  modified_base (273)..(273): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactccgtggacngtcgatcaccatctctgcactgaacngcagtgacgttggtgtcttaataattatcgtctccgtcggtaccaangctatcgaggcacgcccgacccgtaaacttcttaatttatgtacgttcttcgcgcccttgtacggtttcagtctcttcgtccgctcgagtctacggaccaccgtccggcctccacgactcttccacgtacgaccgttccgacgggtcgtacgggaacgggtacggacggtaccttaggtaaacctttagtttacgtcgtaccgaacgtccttactaagttaacgtaacttagggtaaaacttacgtaaacgttacggttactaccgtaacggttacgggttcgttacggggtaccggggtaccggggtaacgggtaaccgttaaccgggttacggtaccccggtacgtaccggtaaccgaccggtaaccccgg

SEQ ID NO: 388369 - DNA, 663 bp, Homo sapiens
  misc_feature: GZ8MTXP02JFP9B.39.39.D06.1.454.CMB.2.raw
  modified_base (255)..(255): a, c, t, g, unknown or other
  modified_base (269)..(269): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttataattntgtctctgtccaangctatcagcacggccgaccctaaactcttaaatttagtcgtacggtttcctttccggtccgtcccttacggtacggggtttactacggtccgtctttccgtccgtctccgtaacgttcgtcggacctacgtaccggtccctacccgtacgtaccctacttccctacgtaacgtacccgttaccgacgggtcgttacgggaacgggaccggaggtaccgttacggttaaactttaacgttttacgtcgtacgtaacgtccttactaattacgtaacgtagtaaagtactaagtacggttacttaccgtacggtcgttcggttacggttccggggacgggaaccgggtaacgttaacggttcggtacccgttacgtaccggtacgtacggaccccg

SEQ ID NO: 388370 - DNA, 608 bp, Homo sapiens
  misc_feature: GZ8MTXP02G29YQ.39.39.D06.1.454.CMB.2.raw
  modified_base (364)..(364): a, c, t, g, unknown or other
  modified_base (381)..(381): a, c, t, g, unknown or other
  modified_base (397)..(397): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaagtggtggagttgggtccgccgacgcccccgagggaacggggctggagttggattggtagaaataaagtggaggaccggggacaaccgaactacaagtgcgtccctacgaggggtcagtcaccatatctgcagacaagtccaaagacctacttctcccgtagacggctgacccctntgtcgaccgcgccgacnccggcatatattatgngctagtagttttgacgtaggattgttagggggcgtacgtcggacgtcgtgggacgtaagggatacgagtcacgtcgtccgtctacgaccgtcctacccgtacgaacggccccgtaagtcccccggttcccttcccccgcggggccctccccgttcgcccgttacccggaaggaccgtacccgacccgtaccggacgaccgaccgaacccgg

SEQ ID NO: 388371 - DNA, 568 bp, Homo sapiens
  misc_feature: GZ8MTXP02FMSAY.39.39.D06.1.454.CMB.2.raw
  modified_base (267)..(267): a, c, t, g, unknown or other
  modified_base (269)..(269): a, c, t, g, unknown or other
  modified_base (272)..(272): a, c, t, g, unknown or other
  modified_base (275)..(275): a, c, t, g, unknown or other
  modified_base (481)..(481): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatcctcctgcactggaaccagcagtgacgttggtgcttatattatgtctctgtcaacngnatnagnacgccgacccgaaatcttaattatgaggttctttcgtcgtccctgtaggggtttctagtcgtcttcgccggtctccgaagtctggaccaacgccggtccctccgtcgaaccctacttctactacgacctccgaggctaggacggacgagtactgaacttattagttgacagtctataactagtactagaagtacaaagtaggttanacccgtagtcgggtacttcgggtccgggcggggtaacggaaccggtaacggttacggacccggttacgtacggtcgaacggaccccg

SEQ ID NO: 388372 - DNA, 668 bp, Homo sapiens
  misc_feature: GZ8MTXP02IPAGN.39.39.D06.1.454.CMB.2.raw
  modified_base (228)..(228): a, c, t, g, unknown or other
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctctgcactcggaaccngcagtgacgttgtgtcttaatattatgtctccgtgttaccaangctattcaggcacgcccgaaccccgtaaattctttaaatttagttggtacgtttccgtttaccggtccgtccccgtttcggttacggggttttcctacggttccgtccgtttaccgttccccggctcccgtaaagttccgtcggtaacccgtaaacccgcccgggtcccccttcccgtacgtaaccctacttccgtaaccgtacgtaaacccgtccgaggtacccgtaggacgggtacggacggtcttacggtaactttacgttagttcgctacgtctactaattatacgtagtaaacgttctaagttaggtacctcgtaacgtcggtcgttcggtccggacggtaacggaaccgtaaggttcccgtaacggtccgtacggtacgaaccggtacccg

SEQ ID NO: 388373 - DNA, 696 bp, Homo sapiens
  misc_feature: GZ8MTXP02HD7CE.39.39.D06.1.454.CMB.2.raw
  modified_base (274)..(274): a, c, t, g, unknown or other
  modified_base (534)..(534): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctggcctccgtgtctgacgacctcctggacagtcgatccacctatcctcctgacacgtacggaaccaggtcaagtggtacgttggtcgtacttaattaattntcgttccctcgttcggttaaccaaactaatacttacgcgacgtacggaccccgaaccccgtaaaacttactttaaagtttaatcggtacggtttcttccggttaccggtcccttggttagggtttccctagtccgttcttccgtccggactccgtagttcctagaaacctaccgaccggtccctaccctagaccctactcctactacggtccaccgaggtacctagggaacggacgtagtctaggttaacctatttacgngacacgtactaacgtactaaatccgtaagtaaacgtaacgtaagttcggtaaactccccgttaaggtcgtccggtttacggggtacggacccggggtaaaggtaaaaccccgttggtaccggtaacccgtccggtaaggtcccaaccggtaaccgtaccggg

SEQ ID NO: 388374 - DNA, 585 bp, Homo sapiens
  misc_feature: GZ8MTXP02ISC4D.39.39.D06.1.454.CMB.2.raw
  modified_base (248)..(248): a, c, t, g, unknown or other
  modified_base (275)..(275): a, c, t, g, unknown or other
  modified_base (309)..(309): a, c, t, g, unknown or other
  modified_base (333)..(333): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgagacctcctggacagtcgatcaccatcctcctgcactcggaaccagcagtgacgttggtntcttataattatgtctctcgtaccaangcatcgagcacgccgaccctaattacttaatttngtagtcttcgtcgcctgtggttcngtctcttcgtccgtctctagtctcgacctacgaccgtccctccgtcgacctactctactacgcctacgaggcgtaggacggcgtacggtctagttaacgttatttagtcgacgtacgtcttactaatttacgtacgtaacgtaatacgaaagtttcggtaactcccgttaacgtcggtacgttcggggttccggacgggaacggtaacgtacggtacgtaccgttacgtacggtaccgaacggtaaccccgg

SEQ ID NO: 388375 - DNA, 613 bp, Homo sapiens
  misc_feature: GZ8MTXP02F45LC.39.39.D06.1.454.CMB.2.raw
  modified_base (232)..(232): a, c, t, g, unknown or other
  modified_base (246)..(246): a, c, t, g, unknown or other
  modified_base (269)..(271): a, c, t, g, unknown or other
  modified_base (564)..(564): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgccctccgtgtctgagactccgtggacagtcgatccacctatctcctgcactggaaccngcagtgacgttgtnattatatatgtctctgtaccaannnatcagcacgccgacccaaattcttaattatgtacggtttcttaccgtccggcccttgtacgggtttcctagtccgtcttcgtccgcctccgtagtcgtaggacctaaccgtacggtcccctcccgtacgaacctacttccgtactaacgtaccctcgacgtctagggaacggacgtgggtccttagtaacttagtttacgtagtacgattacctacttaaattaaccgttaaacgtaaggtaaatacgtaaagttcggttactacccgtacgtcggtacgttcgggtaccggngggtaaacgaacgtaaagtcccggacgtaccgtacgcgtacgaacccgg

SEQ ID NO: 388376 - DNA, 565 bp, Homo sapiens
  misc_feature: GZ8MTXP02HHQQN.39.39.D06.1.454.CMB.2.raw
  modified_base (271)..(271): a, c, t, g, unknown or other
  modified_base (463)..(463): a, c, t, g, unknown or other
  modified_base (468)..(468): a, c, t, g, unknown or other
  modified_base (474)..(474): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccagcagtgacgttggtgtcttataattatgtctcctgttaccaanagctatcaggcacgccgaccccgaaattcttaatttatgtacgttcttcgtccgtcctgtacggggtttctagtccgtcttcgtcccggctcccgtaagttctacggaccaaccgaccggcccttcccgtcgaccctacttaccctctacgcctccgaggtctaggaggacgtaggctagtaattattacgngtacngtactntatttgactatcgagtgacgtcttagtcgttagttacggagtcggaacctaaggtcacgttcgtaccgtaggtaccacgacccgtaaccgg

SEQ ID NO: 388377 - DNA, 624 bp, Homo sapiens
  misc_feature: GZ8MTXP02FLWAP.39.39.D06.1.454.CMB.2.raw
  modified_base (229)..(229): a, c, t, g, unknown or other
  modified_base (244)..(244): a, c, t, g, unknown or other
  modified_base (267)..(267): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatctctgcactggaaccngcagtgacgttggtnctataatatgtctctgttccaanagcatcaggcagccgaccccgaatcttaatttatgtaggttctttcgtcggtccctcgtacggggtttctagtcgtcttctccggctccagtctggaccaacgacgtcctccctgaccctatctctacggacctccgagggctaggaacggacgaggctacggtaacttatttagtcgggacctaacgtcctactacttaaagtaccttaggaaaacgttcgtaaaagttacgggttaacttccccgtaaagttcggggtactttcggggtttaccggggacggggtaaacggggtaacccgtaaacgggtttaccgaacccgggttcggtaaacgggtaccgaacggtaaccccgg

SEQ ID NO: 388378 - DNA, 642 bp, Homo sapiens
  misc_feature: GZ8MTXP02GGDHP.39.39.D06.1.454.CMB.2.raw
  modified_base (442)..(442): a, c, t, g, unknown or other
  modified_base (450)..(450): a, c, t, g, unknown or other
tcagtcgcactagtcacgaccggtgctcgatttagtgacatctcgcagttcttcctcctcctggtggcagctcccagatgggtcctgtatcaggtgcagctgcagcagtcgggcccaggagtggtgaagccttcggagaccctgtccctcacctgcgctgtgtctggagcctccctcggcggagatgaagtggtggaggttgggtccgccgacgcccccgaggggaacggggctggagttggattggtagaaataaagtggaggaccggggacaccaactacaagtgccgtccctcgacggggtcagtccaccgatactctgcaggacaaggtccaaaacgaaccctacttacctccctagacggtctacgacccctcgtgtcgaccgccgacggactccgggaccaatacttattaactggtgacgtagttagtttttcgngtaaggtnttcggttaggggcgttagtcgtacgttacggtggggtacgaaagggtctcggtacgtacgacgttcgtccgttcctcgacgtcctccgaaccgtacgggcccctagttcccggtcccttcccccgtggcccgtcccgttcgacccgttacgaacgggcctaccgtaccccgacgggacacggacccaaccgg

SEQ ID NO: 388379 - DNA, 583 bp, Homo sapiens
  misc_feature: GZ8MTXP02JGYSN.39.39.D06.1.454.CMB.2.raw
  modified_base (229)..(229): a, c, t, g, unknown or other
  modified_base (242)..(242): a, c, t, g, unknown or other
  modified_base (251)..(251): a, c, t, g, unknown or other
  modified_base (253)..(253): a, c, t, g, unknown or other
  modified_base (266)..(266): a, c, t, g, unknown or other
  modified_base (268)..(268): a, c, t, g, unknown or other
  modified_base (352)..(352): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatctctgcactggaaccngcagtgacgtgtntattatatntntctctgtaccaananctatcgaggcacgaccgacccctaaattactttaattagtgtacgttcttcgtcgtccgtagtccggtttctagtcctcttccnccgtctccgagtctacgaccaacgccgtccctccctcgacctatcctacgtacgcctccgacgacgtaggacggacgtacgtcttacgttacttagtttagtacgactacgtactacgtaattaacgtacgtagtaatactaaggtcgtactccgtacgtcgtcgttcgggtaccggacggtaacggtaaccgtacggtttaccggaccgttacgtacggtaccgacgccg

SEQ ID NO: 388380 - DNA, 611 bp, Homo sapiens
  misc_feature: GZ8MTXP02JRE9U.39.39.D06.1.454.CMB.2.raw
  modified_base (499)..(499): a, c, t, g, unknown or other
  modified_base (592)..(592): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccagcagtcgtacgttggtggttatgactatgtctccgtaggtaccagcaatactcagcacaccgacccccaaactcatactacttataggagtacagtaactcccggccttacgtacggggtttactaagtccgtctttctctcggccttacgaagtcgtcgacctaaaccgaccggtccctacccgtacgaccctattcccgtccgtcgggcccttacgacggtcgtacggaacgggtacggaccgtgttagttaacgtttatttaacgnggactacgtccttcgtatttacgactaacgtcgtaaagtcggtacggttactttagtcggtttacggtacggtaaaggtcggaacgtacggtntaacgttccgtacgttacg

SEQ ID NO: 388381 - DNA, 769 bp, Homo sapiens
  misc_feature: GZ8MTXP02HAPX7.39.39.D06.1.454.CMB.2.raw
  modified_base (304)..(304): a, c, t, g, unknown or other
  modified_base (525)..(525): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgaggtcctgggcccagtctggcctgacacagcctgcctccgtgtctgacgactccgtggacagtcgatccacctatcctcctgaccacgtacggaacccagccgtaaggttcggtacggttggtattacttaattaatttatcgtccttccgtgttacccaaangtactattcgagcgtaacgccccgtaaaccccgtaaatttacgtttaaactttagtcggttaacggtttcccgtttaccgggtccccgtcccgtttaggttacggggtttttccacggttccgttccgtttccggcccgtcttaccgtaaacgttcgtaccggaaccaacccggtcccgtacccttcccgtacgacctactcctacgaacgtccctaacgnggtaccgtgggaaacggacgacgggtctaggttaaaccttgtttaagtccggacgttaactactaacttaactaacgttacgttaagggtaaaccttagtaaaggtttaccgtaaccgttccgttaacgtcgggttaccgggtttacgggttacccgggggaacgggttaaaaccggtaacccggttaaggtttacccggaacccgggttaccggtaacgtcccgaaaccgggggtaacccccg

SEQ ID NO: 388382 - DNA, 554 bp, Homo sapiens
  misc_feature: GZ8MTXP02G2XD1.39.39.D06.1.454.CMB.2.raw
  modified_base (302)..(302): a, c, t, g, unknown or other
  modified_base (390)..(390): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctctgtccaacagcatcaggcagccgacccgaaattcttaatttancgtagttctttcgtccggccttgtacggggtttctagtcgtcttcgtccggctccgagtctggaccacgacgcctccctagaccatcnctagactccaggcagacgacgagtctagtacttattagtcgctagcctactattactacgttaggaaattcgaaagtttcggtaactccgtacttggcgtttcggtacggacgggacggtaacgtaaagttcgaccgttaccgtacggtaaccgcgtaaccccg

SEQ ID NO: 388383 - DNA, 569 bp, Homo sapiens
  misc_feature: GZ8MTXP02FQKGE.39.39.D06.1.454.CMB.2.raw
  modified_base (382)..(382): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaagggctgagttggattggtagaaataatgaggaccggggcacaacacaatgcgtcctcgaggggtcgagtcaccatatctgcagacaagtccaaagaacccacttcctccctgagctgacccctctgtcgaccgccgcggactcggccatactattattgngcgtagtgttttgctaggtattcgttggggcgttagtcgtacgtcgtggggtacgaagggtatcgacggtcacgttccgtccgtcctacgacgttcccaccgaccgaacgggtccctaacgtccggtcccttccccgtggcccgtccctgccctcgaaggcgaccacccgtcgacgacgaccgaccg

SEQ ID NO: 388384 - DNA, 732 bp, Homo sapiens
  misc_feature: GZ8MTXP02HXQL3.39.39.D06.1.454.CMB.2.raw
  modified_base (203)..(203): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacacgcctgcctccgtgtctgagacctcctgaacngtcgatcacatctactgcactcggaaccagcagtgtacggttggtgtattataattatcgtctctcggttaccaacagctatcgacgcacgcccgaaccccgtaattacgtttaatttacgtaggttacggtttcttcggtccgtccgttacggtccgggtttctacgtccgtacctttccgtccggacttcgtacgtcgtacgacctaaccgccggtacccttcccgtgaacctacttaccgtctacggaacccttccggaggttcgtaagggacgggtaacgaccggtacgttacgtaaagtttacgtttaaacgtcgaccgtaacgtcctacgtaaacttacgttaaaccgtaggttaaacgtaaccgtaagggtttaccttaaaaccggtccttaaacggttccggggttaaactttccggggggttaaaccggaccgggggtaaacgttaaacccgttaaacggttcccggttaaaaccccggtacggttaaccggtaacccgttaacccggtaaacccccggg

SEQ ID NO: 388385 - DNA, 721 bp, Homo sapiens
  misc_feature: GZ8MTXP02FQGT4.39.39.D06.1.454.CMB.2.raw
  modified_base (200)..(200): a, c, t, g, unknown or other
  modified_base (227)..(227): a, c, t, g, unknown or other
  modified_base (271)..(271): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacngtcgatcacatctctgcactcggaacngacagtgacgttggtgtcttataatatgtctccgtgttaccaanagtcattcaggcacggccgaccccgtaaacttcttaaatttagtcgtaaggtttccgtttaccggtccggtccccgtttacgtacgggggttttcctacggttcgtcctttccgtacccggtcttacccgtaaagttccgtacggtacctaaaccgtccggggtacccttcccgtacgtaaccctaacgttcctaaccgtaacgtacccttaccgacggtccgttaagggacgggaaaccggaacggtcgttaacgtaaaccgtttagtttaagtttcgacgtagtcccttaacgtaattaacgttaaccgtagggtaaaactcgtaaaagttacggttaacctaccgtacgttcgggtactttcgggtttaccggggacgggtaaacggtaacccgttaaggttacccggacccggtttaccgtaacggcccgtaacggtaacccccgg

SEQ ID NO: 388386 - DNA, 687 bp, Homo sapiens
  misc_feature: GZ8MTXP02F75K6.39.39.D06.1.454.CMB.2.raw
  modified_base (292)..(292): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggccaggagtggtgaagccttcggagaccctgtccctcacctgcgctgtgtctggagcctcccgtcggcggagatgaagtggtggaggttgggtccgccgacgcccccgaggggaagggctgagttggagttggtagaaataaagtggaggaccggggacaaccaactacaatcgcgtccncgagggtcgagtcacatatctgacaagacaacgtaccaaacgaacccacttcctccctaggacgctacgacccctactcgtacggacccgccggaccggtaccgtccggggacctaaagttaaactttaacgtttagttaggtcggtacgttaagtttagtttttcggacgtaggtacgtttggttacgggggcgttaagtccggtacggtcgtgggggttacaaaggggactcgtacggtctaagtccgtaccgtccgtacgacgtccctaccgaaccggaaccgggcccctacgttccccgggtaccctttcccccggcggtccccgtaccccttcgacccgttccgaacggtaccgtaccgaaccccggtccgacggacccgacgaacccgg

SEQ ID NO: 388387 - DNA, 785 bp, Homo sapiens
  misc_feature: GZ8MTXP02HB41F.39.39.D06.1.454.CMB.2.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgccctccgtgtctgagacctccgtggactagtcgatccacctatcctcctgcacgtacggaaccagctaggtgtacggttggtgtacttaataattatcgtccttccgtacggttacccaaactacgtactagttccgacgggtaccgacggaccccgtaaccccgtaaaactttacctttaaatttacgtcggttacggtttaccgtttccggtaccggtcccgttacggttacggggtttacctacggttcccgtccgtttcccgtcccggtaccttccgaacgttcgtacggaccctaaacccggtcccgggtcccccttacccgtacgtaaccctacgttccgtacgtacgtaccctaccggtacggtcgtacgggtaacgggacgtacggtacgttagtaaccgtttaatttacgttacgacggtactaccgttactaactttaacgtaacgttacggtaaacgttaacgtaaacggtttacggtaacttaccgtaaccggtttcgggtcgtttacgggggttaccggggtacggggtaaccgggtaacggttacggttacccggtacccggttaccggtacggtaccgtaccggtaaccccggg

SEQ ID NO: 388388 - DNA, 629 bp, Homo sapiens
  misc_feature: GZ8MTXP02JJFR7.39.39.D06.1.454.CMB.2.raw
  modified_base (269)..(270): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttatattatgtctcctgtaccaacnncatcagcacgccgacccgaaacttcttaatttatagtagttctttcgtccgtccctgtacggggtttctacgtcgtctttccgtccggctccgtaagtcgtggaccaacgaccggtcccctacccgtacgaccctacgtcctacgtaacgtccctaccgacggtacgtaaacggacgtacggtcttaggaccttaagtttacttcgacctagtactactaagttaacttacgtaaggtaaccgttagtaaattgggttaaacctccgtacgttcgggtcgttacgggttacggggacgggtaacggtaccgtaagttccggtaacccgttaccgtacgtaccgaccgacccgtaaccgg

SEQ ID NO: 388389 - DNA, 698 bp, Homo sapiens
  misc_feature: GZ8MTXP02I0HD4.39.39.D06.1.454.CMB.2.raw
  modified_base (243)..(243): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctcggcctgacacagcctgcctccgtgtctgagacctccgtggacagtcgatccaccacttctcctcgacacgtacggaaacccgngacgtaggtcgtacggttggtcgtacttaattattagtcgttccttccgttacgtaccaacacgtctatacgcgacgaccgaccctaacccgtaatttacttaagtttacgtaggttacgtttccgtttccgtcccggtccgttacggtacgggtttccttacgttccgtccgttccgtcccgtacctcgtacgtccgtacgaccctacgacccgtccctaccgtacacctatccacgtacgtaccgtacgacggtcgtaggaacggacgtgtacgtacgtactttatagtcgacgtactactactaacgttacgtagtacgttaaagtcgttaacggttacgtacctcgtacggtcggttccgggttacggggtaccggggaacgggtaaaccggtaaccgttaacggttaccggtacccggttacggtacggtaacccgtaccggtaacccgg

SEQ ID NO: 388390 - DNA, 754 bp, Homo sapiens
  misc_feature: GZ8MTXP02HP26G.39.39.D06.1.454.CMB.2.raw
  modified_base (245)..(245): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacgcagcctgcctccgtgtctgagactcctggacagtcgatcaccatctcctgcactcggaaccagcagtgacgttggtntcttataattatgtccttccgtggttaccaaacagctattcaggcacggcccgtaacccccgtaaaacttcttttaaaatttagtcggttacggtttccttttaccggtcccggtccccttagtaaccgggggtttttcctacggttccgttcccgttttccgttccccgggtacttacccgtaaacggttccgttacgggaaccccaaaacccgtacccccgggtcccctttacccccgtacgtaaccctaacctttcccgtaaccgttaacggttacccctacccggtaagggtccttacgggaacgggttaccgaacgggtccttacggtaacctttagttttagttacggactacgtacttacgtaattactaacgttagtaaagttccaaagtttacgtactttaccacggttcgggtactttcgggttaccggggacgggtaacgggtaaccgttacggttaccggtacccgttaccgttacgggaccgtacgtaacccccgg

SEQ ID NO: 388391 - DNA, 641 bp, Homo sapiens
  misc_feature: GZ8MTXP02FHB8C.39.39.D06.1.454.CMB.2.raw
  modified_base (229)..(229): a, c, t, g, unknown or other
  modified_base (451)..(451): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccacatctcctgcactggaaccngcagtgacgttggtgcttataattatgtctctggtccaacagcatcaggcacgccgaccccgtaaactactttaaatttatggtacggtttccttttccggccggtccccttcggtaccggggttttctacgtcgtctttccgtcccggctccaagtctggcaacacggtccctccctcgtaccatcctactacgaccctaccgaggcctgggaacggacgngggtctacgacttagttatcgacagtcctacaattaactacgtagaaacgttacaaagttcggttaaactccctaaacggttgggtccgttacggggtttccggggacggggttaaacgggggaacccgttaaaagggttccggtaaaaccccggttccgtaacggggttacccgaacgtaacccccggg

SEQ ID NO: 388392 - DNA, 734 bp, Homo sapiens
  misc_feature: GZ8MTXP02HSJ5K.39.39.D06.1.454.CMB.2.raw
  modified_base (561)..(561): a, c, t, g, unknown or other
  modified_base (714)..(714): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctccctcggcggagatgaagtggtggagttcgggtccgccacggcccccgaggggaagggctggaggttggattggtagaaataaagtggaacggaccggggacaacaactacaatcgccgtccgtagaggggtcagtaccacctatactcgtcgacaagaaactaaacgtaccaaaacgaaaccctacctttcctaccctggaacggtcgtacgacccctcgtcgtaccggacccggtccggtcccggtaacgtcccgggtacctaaactttaacgttactttaagttcgtggtaccggtagtttagtttttcggacgtaaggttacgtttcggttgggggtccgttaagtccgggtaacgttcggtacgggggtacgtaaacggggtnttaccggtacggtactaacgttccgttccctaccgtaccgtacgtccccttaacccgaacccgtaaaccgggccctacggttccccggtttcccgtcccccgtcgggaccctcccgtacgtcccgtaccgaacggtacccaccggtaaccccnccggacgaaccgaccgaacg

SEQ ID NO: 388393 - DNA, 731 bp, Homo sapiens
  misc_feature: GZ8MTXP02JH6XL.39.39.D06.1.454.CMB.2.raw
  modified_base (261)..(261): a, c, t, g, unknown or other
  modified_base (265)..(265): a, c, t, g, unknown or other
  modified_base (280)..(280): a, c, t, g, unknown or other
  modified_base (283)..(283): a, c, t, g, unknown or other
  modified_base (291)..(291): a, c, t, g, unknown or other
  modified_base (312)..(312): a, c, t, g, unknown or other
tcagtcgcactagtcacgaccggtgctcgatttagtgacatctcgcagttctttggggggggtctcaggaggcagcgctctcaggacatctccaccatggcctgggctctgctgctccctcaccctcctcactcagggcacagggtcctgggcccagtctggcctgacacagcctgcctccgtgtctgacgactccgtggacagtcgactcacctacttcctcctagcacgtacggaccagcagtgtacgttgcgtattanattntgtctctacgtacangtnatcgagcncgacccgtacccctaaatttnttaacgtttagtcgtacgtttcgttaccgtccgttcctacggtacggggtttctaccgtccttccgtttaccgtcccggccttaccgtagttaacccgtggtaaacccgtaccggtaccccgggttaccccctaccccgtacgtaacccttactttaccgtaccgtacccgttaacctcccggtacgggttacgaacggggtaacgggacgtgggttaccttaggttaacccttagggtttaactgacccggttataccgttataacggtttaactaacggtaggtaaacctataaaggtttacccggttaacgttccgttaccggtggtaccggtttccggggaacgggggtaaccggtagaaacccggttagttccggtaaaccggtccggttaaccggaccgacgtaaacccccgg

SEQ ID NO: 388394 - DNA, 640 bp, Homo sapiens
  misc_feature: GZ8MTXP02FS3JK.39.39.D06.1.454.CMB.2.raw
  modified_base (247)..(247): a, c, t, g, unknown or other
  modified_base (272)..(272): a, c, t, g, unknown or other
  modified_base (275)..(275): a, c, t, g, unknown or other
  modified_base (513)..(513): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacacgcctgcctccgtgtctgagactcctggacagtcatcaaccatcctcctgcacgtcggaaccagcagtgacgttggtntacttaatatatgtctctgtaccanagntatcagcacgccgaaccccgtaaattctttaatttacgtaggtacggtttacctttccggccggtcccttggtaccgggttttctacgtccgtaccttccgtccgtctcgaacgtcgtacgtacccgaaacgcccggtaccctccgacgacctactcctacgtacaccgtcccgaggtacacgggaacgaccggtagccgttagaaacttcgtttaagttcgaccgtaatacccttanaaattagtaactaggaaattacgtaaacggttacgtaactaccgacggttacgtcgtttacgggcggaacggggaagtaacccgtggtaaccgtacccggtcgttaacggacccgacggtaaacccg

SEQ ID NO: 388395 - DNA, 677 bp, Homo sapiens
  misc_feature: GZ8MTXP02HPDZA.39.39.D06.1.454.CMB.2.raw
  modified_base (275)..(275): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacacgcctgcctccgtgtctgacgactccgtgacagtcatccacatcctctgcactgaaccagcagtgtacggttgtgtacttataattatcgtctcgtgttaccaagngactattcgagcacgcccgaccccgtaaattacctttaatttagtggtacgtttccgtttccggtccggtcccgttcggttaccggggtttctacggttcctccgtttccgtcccgggtccttaccgtacgttccgtacggacccaaccgaccggtccccttcccgtacgacctacgttacctactacgtacccgttacgacggtcgtacggacgggacgacggttacctaggttaaacctttagtttacgtcgtacgtactcttaataattacttaccggaagtaacgttactaaagttcgtaaccttccggacgtttcggtcgtttcgggtacgggacggtaacgggtaaacctaacggttaccggtacccgtacggtaacggtaccgaacgtaccccgg

SEQ ID NO: 388396 - DNA, 650 bp, Homo sapiens
  misc_feature: GZ8MTXP02HU97T.39.39.D06.1.454.CMB.2.raw
  modified_base (435)..(435): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgccctccctcggcggagatgaagtggtggagttgggtccgccacgcccccgaggggaagggctggagttggattggtagaaataaagtaggaacggaccgggggacaaccaactacaatgccgtccctcgaggggtcgagtcaccatatctgcagacaagtaccaaagaaccctacttcctaccctgacggtctcgtacccctctggtacgacccggccgaccggactccgggcctaattattattatgtgtgagttgttttcggngtaggtgttgggttggggtcgtgtcggtacggtggtggggtacggtaggtcgtacggtacggtctacgtccgtctcctcgaccgtccctacccgaaccggaccggtacccgtccgttcccggttcccccgttcccccgtcccggtcccgtccccgtcccgtcccgtcccgaaccggaccgacccgtacccgacccggaccggaccgaccgacccg

SEQ ID NO: 388397 - DNA, 795 bp, Homo sapiens
  misc_feature: GZ8MTXP02IV7WE.39.39.D06.1.454.CMB.2.raw
  modified_base (750)..(750): a, c, t, g, unknown or other
tcagtcgcactagtcacgaccggtgctcgatttagtgacatctcgcagttcttcctcctcctggtggcagctcccagatgggtcctgtctcaggtgcagctgcagcagtcgggcccaggagtggtgaagccttcggagaccctgtccctcacctgcgctgtgtctggacgcctccgtcggcggagagtgaagtggtggtaggttcgggtccgccgaccggccccccggaagggggaacggggcgttaggtaaggttgggtagttagggtagtaaaagtaaagtaggaacgggaacccgggggccaaaccgaaactaacgaaagtcggccgtccccgtacgaggggtccgaacggtaccaacctataactcgtagacaagaacaacgtaccgaaacgaaaccctacttcctacccgtaggtacggctacgtaacccctcgtacggttccgacccggtccggaccgggtactcccgggaccctaagttaaactttaacgtttaagtttcggtacggttacgggttaagttaacggttttttcgaccgttaaggggttacgtttaacggggtttcgggggtacgtttaacggtaccgggttaccgggttacgggttacgggggtaaccggtaaaaggggttacgtacgggttaccgtacgtacgtacggttccctcctacggactcccgtacccaacggtaccgacccgtacgtcccgttccccgttccccgcggccccgtccgtcgtacccncccgaacggtacccaccgacccgaccggacgacggaccgacccgg

SEQ ID NO: 388398 - DNA, 663 bp, Homo sapiens
  misc_feature: GZ8MTXP02GD5Y6.39.39.D06.1.454.CMB.2.raw
  modified_base (242)..(242): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctctgcactggaaccagcagtgacgttggtncttatattatcgtctcctggttaccactagcattcgaggtcagcccgaaccccgtaaattctttaaatttagtgtacggtttctttacgtccgtacccttggtacggggtttcctaggtctacttcgtcccgacttccaagtcgtacggacctaaccgcggtccctacctacgaccctacgtcctacctacgtaaccctccgagggcctaaggacggtacggtaggtctacggtaactttacgttaagtttcgaccgtagtaccgtaacttattaaacgtacggtttagaaacgttacgtaaaaggttacggttaaactccggtaaccgttaggggtcccgttacggggtttacggcgggtaacggggtaacccttaaggtaccggtaccgtaccgtacggggtacctaaccggtaacccg

SEQ ID NO: 388399 - DNA, 731 bp, Homo sapiens
  misc_feature: GZ8MTXP02IK7M9.39.39.D06.1.454.CMB.2.raw
  modified_base (189)..(189): a, c, t, g, unknown or other
  modified_base (260)..(260): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctganctctggacagtcatcaccactcctctgcacgtggaaccagctaggtgacggtttggtcgtatttataattntcgtctccgtgttaccacagtctattcgaggcctacggcctaaccccgtaaacgttactttaatttagcggttagtttccccgtttacgtccgggtccccttaggtaccggggttttcctaggttcccgtccttccggtacccggtcctcccggtagttcctacggtaccaacccgtaccgggtcccccttacccgtactaccctactttccctacgttaacgcccgttaccgacgggtcttaacgggggacgtacggtacggtaccgttaggtaacttttaaaccgtttgtaaccgtcggtactcccctataaagtttcgtaaacttacggttaaactcgtaaaaggttccggttaaccctccttaacggtcggttaccggttcgggttaccggggaccggggttaacggtaacccttaacgggtttaaccgtcccgggttaccgtacggtacccgaacggtcccccggg

SEQ ID NO: 388400 - DNA, 648 bp, Homo sapiens
  misc_feature: GZ8MTXP02GUEWG.39.39.D06.1.454.CMB.2.raw
  modified_base (328)..(328): a, c, t, g, unknown or other
  modified_base (504)..(504): a, c, t, g, unknown or other
  modified_base (512)..(512): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatcctcctgcacgtggaaccagcagtgtacgttggtgtacttataattatcgtccttaccgtaggttaccaactgtacctaattcgaggtccacggaccccgaccccgtaaaatttntttaaatttagtgtacggttctttccggccgtacccttgtaccggggtttcagtcgtaccttccgtcccggctccgaagttcgtcggaccaaccgcgtcccttcccgtacgacctactcgtactagaccctcgacggtctggaacggtacgacggtctacgtaacttagtttacgngaccgtancttaacattacaacgtagtaacgtacaacggtttcggtaacctaacgtccggtaggttccgttacggggtcccggggaacggtaaggaaccttacggtttaccggaccctcggtaacggacccgtaaccgccccgg

SEQ ID NO: 388401 - DNA, 690 bp, Homo sapiens
  misc_feature: GZ8MTXP02I2ZZB.39.39.D06.1.454.CMB.2.raw
  modified_base (245)..(245): a, c, t, g, unknown or other
  modified_base (257)..(257): a, c, t, g, unknown or other
  modified_base (272)..(272): a, c, t, g, unknown or other
  modified_base (517)..(517): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatctcctgcactcggaaccagcagtgacgttggntacttataattntgtctctggtccaangctatcgaggtcacggcccgaccccgtaaattctttaaatttactgtacggtttcctttcggtcccggccgttcggtacggggtttcctacggttccgtctttccgtcccggtctaccgtagttccgtacggaccaaccgtccggcccttccctacgaccctacttcccgtacttacgacccttccgacggtctagggacggaacgcggtactacggttacctttaagttttatcggaccgttanaccccttagtaacttaccgtaagttacgaagtttacgtaaagttcggttactaccgtacgttcgggtaccttcgggggttaaccgggacggttaaaccggggaacccgtttaaacggggttccggtaaaaccccggttccggtttaccggtaacccgcggtttaaaaccccgg

SEQ ID NO: 388402 - DNA, 614 bp, Homo sapiens
  misc_feature: GZ8MTXP02IQ5HE.39.39.D06.1.454.CMB.2.raw
  modified_base (226)..(226): a, c, t, g, unknown or other
  modified_base (267)..(267): a, c, t, g, unknown or other
tcagtcgcactagtcacgaccggtgctcgatttagtgacatctcgcagttcttttgggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccatctctgcatggaaccngcagtgacgttggtgcttatattatgtctctggttccaacngcattcaggcagcgaccccgaaactcttaatttactgtagttcctttcgtccggtacccgttcgtacggggtttcctagtccgtctttccgtcccggtactccgtaaagtctacggccaaccgaccggtcctccctcgaccattccactgaacctcgacggctagaggacgaggtacctggacttacttagtcgtacgagtcctcaattacttaaaccgtaggtaaagtcgtaaaacgttacggtactacctaacgttcggtcgtttacggttccgggacgggtaaacgggtaaccgaaaacggtttcggtaacccgttaccgtacggttaccaaccgggtaccccg

SEQ ID NO: 388403 - DNA, 644 bp, Homo sapiens
  misc_feature: GZ8MTXP02FQCNU.39.39.D06.1.454.CMB.2.raw
  modified_base (232)..(232): a, c, t, g, unknown or other
  modified_base (255)..(255): a, c, t, g, unknown or other
  modified_base (267)..(267): a, c, t, g, unknown or other
  modified_base (269)..(269): a, c, t, g, unknown or other
  modified_base (273)..(273): a, c, t, g, unknown or other
  modified_base (290)..(290): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggcctgacacagcctgcctccgtgtctgagactccgtggacagtcgatccactactctcctgcacgtggaaccngcagtgacgttgtgtcttatatntgtctctgtcangnatcngcacgccacccgtaatnttaattgtgtagttcttcgcgtcctcggtacggttctagtcgtcttcgccgtctcgacgtcgtgacctacaccggtcctcctacgacctacgtctacgtacgacccttacgacggtcgtacggacgggaccgtacggtacttacgtaactttattaaccttggaacgtacgtacccgttataacttaaacgttacgttaacgtaaacggtactaaaggttacgtaaactccgtaaacggtttcggtaccggtttacggtaccgggggtaacgggtaaccgggttaaccgtaacggggtttacccggtaacccgggttaccgtttaacgggacccggtaaaccggtaaccccggg

SEQ ID NO: 388404 - DNA, 773 bp, Homo sapiens
  misc_feature: GZ8MTXP02F7CK4.39.39.D06.1.454.CMB.2.raw
  modified_base (230)..(230): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacagggtcctgggcccagtctggccctgacacagcctgcctccgtgtctgagacctcctggacagtcgatcaccatctcctgcactggaaccngcagtgacgttggtgtacttataattatgtctcctggttaccaacagctattcgaggcacgaccgacccccgtaaaattctttaaatttatcggtacggtttctttaccgtccggtccccgttgtaacggggttttcctagtcgtctttcgtcccggctttcccgaaagttccgtagggaacctaaacccgtaccgggtcccccttacccggtcgtaaacccctaatttccctaacgttaacctacccgttacccgacgggtcttaacggggaacgggtaaacccggaggtacccgttaaaggtaaacctttaaacgttttaagtttacgcccgtaaggtccccttaacgtaaattaacccttaaacggttaaacggaaaagttaaccttaaaaacggttgggttaaaaaccttcccccggaaacgtttacggggtcccgtttagggggtttacccggggaccgggggttaaaacggggaaccctttaaaaggggtcccgtaaaaccccgggttcggtaacggaaccgaccggtaacccccgg

SEQ ID NO: 388405 - DNA, 696 bp, Homo sapiens
  misc_feature: GZ8MTXP02FKSNX.39.39.D06.1.454.CMB.2.raw
  modified_base (233)..(233): a, c, t, g, unknown or other
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctccgtgtctgagacctcctggacagtcgactccaccatctcctgcacgtaggaaacngcaggtgacggttggtgtacttaattaattatgttacctccgttacgttacccaaacgagtactattcgaggccacgacccgaaccccgtaaaattctttaatttagtgacggtttctttcgaccggtcccttgtaccgggtttctacgtcgtctttacgccgtactctaacgtctagtacaaccgtcgtccctcgtactacgtatacctactacgacctaccggacgtcgtacggacggacgtacgggtacctaggtaacctttaagttacgttcggaacctagtacccgttacaaagttacttaaaccggtaagtaacgttacgtaaaacgttaccggttacacccgttacggtagggtacccgtttacggggttacccggggtacgggtaaaacgggtaacccggtttaaaacgttccgggtacccgttacgtttaacggacctaccggtaaaccccggg

SEQ ID NO: 388406 - DNA, 530 bp, Homo sapiens
  misc_feature: GZ8MTXP01C683A.11.67.G01.1.454.CMB.2.raw
  modified_base (192)..(192): a, c, t, g, unknown or other
  modified_base (266)..(266): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctccaatatcggaagtaacgatgtcaaattggtatcaacatcnccccggtacggcccccaaactcctcatctataggaatagccagcgccctcgaggggtccctggccgattctctggcttcgaagtctggcacctcaacgccctcccgtggccctgccagtgggctccagtctgagatgaggctgactattattgtgcagcgggtgggatggacggtcgtgagtgctggtggtcgttcgggcgggtaagggaccaagcttgaccgtcgttgggttcagcccaggctcgccccgttcgtcgcgtccg

SEQ ID NO: 388407 - DNA, 371 bp, Homo sapiens
  misc_feature: GZ8MTXP01ETMQI.11.67.G01.1.454.CMB.2.raw
  modified_base (368)..(371): a, c, t, g, unknown or other
tcagcgagagataccacgaccggtgctcgatttagagtatacatattgggtttgggaacctatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagccccaaggctcgccccctcggtcactctcgttccccaccctcctcgtatctctcgctgagccgggctggcaaggcgcatgnnnn

SEQ ID NO: 388408 - DNA, 523 bp, Homo sapiens
  misc_feature: GZ8MTXP01DF1R3.11.67.G01.1.454.CMB.2.raw
  modified_base (310)..(310): a, c, t, g, unknown or other
  modified_base (428)..(428): a, c, t, g, unknown or other
  modified_base (460)..(460): a, c, t, g, unknown or other
  modified_base (494)..(494): a, c, t, g, unknown or other
  modified_base (517)..(517): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtctttttcttgtggcttatttaaaaggtgtccagtgtgaggtggagttattgcagtcgtggggggggcttgggtgcaggccggagggggtccctgagactctcctgtgtaggctctggattcagttagcagctacgccatgacctgggtccnccaggctccgagggaagggctggagtggtctggctatatggcccaggtgcaagacaatactcgcagagtccgtgcgagggccgatgcaccatctccagagacaattcccagaacgacnctggtaaccctgaccaaatggacagcctgagngccgacgacaacggcgttatattacgtgtgaccngaaactccgaccaagatattgcncgtggg

SEQ ID NO: 388409 - DNA, 640 bp, Homo sapiens
  misc_feature: GZ8MTXP01BXYA8.11.67.G01.1.454.CMB.2.raw
  modified_base (211)..(211): a, c, t, g, unknown or other
  modified_base (215)..(215): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtctcgggaccccccgggnaganaatcaccatctcttgtactggaagcagcctaccaaatacgtacggaaagtaacgatgtacaagttggtatacaactactcccgtacccccggtaccgacccccaaactccctacatactaagtaaggaatacgaccacggccggtccctcggacggggtccctcggccccgtattctcgtcggcctaacgaagtcgtcggcctaccctcacgtccctcccgtcggccctgcgtaggtcggcctccgagttcgtaggaggtgtggacggtctagtacgtttagtttagttggtcgtcgaggtcgggtagggtagtcggtacggtcgtggtggtgtcgttgggttcggttcggttcggggacgggacgggaccgacggtccgtacggtcccggttccggtcgggttaccgtaaccggcccgtaacgg

SEQ ID NO: 388410 - DNA, 546 bp, Homo sapiens
  misc_feature: GZ8MTXP01ELBTS.11.67.G01.1.454.CMB.2.raw
  modified_base (196)..(196): a, c, t, g, unknown or other
  modified_base (273)..(273): a, c, t, g, unknown or other
  modified_base (539)..(539): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaagcagctaccaatatcggaaagtaacgatgtcaaattggtatcaacatccnccccggtacgcccccaaactcctcatctataggaatacgccagccggccctcgacgggggtccctggccgattctctggctcgaacgtctggcacctcgaacgccctcccgtgccctgcaggtcgggctccgagtcgtgaggatgaggctgtactattattgtgcgagcggggtgggagtggacggtctgagtgcgtgtggtcgtcgggcggaaggaccagcgttcgaccgtcgttggcacgccgagccgtcgccccgttcgtccncgttccg

SEQ ID NO: 388411 - DNA, 550 bp, Homo sapiens
  misc_feature: GZ8MTXP01BATHH.11.67.G01.1.454.CMB.2.raw
  modified_base (209)..(209): a, c, t, g, unknown or other
  modified_base (392)..(392): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtctcgggacccccggnagagaatcaccatctcttgtactggaagcagctaccaatatcggaagtaacgatgtacaattggtatcaaacatcctccccggtacgcctaccaaactcctcatctataggaatagccagcggccctgacggggtccctcggccgtattctctggctcgaagtctggccacctcagccctccnggcctgcagtggctcagtctgaggatgaggtctgggacttagttatggtgcgaggcgtgggtatggacggttctggtaagtggcttggttcggtccgttcggggcggagggaccaaggtccgtcggaccccggtcgttcgggtccgaacgaaccccgg

SEQ ID NO: 388412 - DNA, 579 bp, Homo sapiens
  misc_feature: GZ8MTXP01EFW0D.11.67.G01.1.454.CMB.2.raw
  modified_base (194)..(194): a, c, t, g, unknown or other
  modified_base (269)..(269): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctccaatatcggaagtaacgatgtcaaattggtatcaacatccnccccggtacgcccccaaactcctcatctataggaaatgccagccggcctcgagggggtccctggccgtattctctggctcgaacgtctggctacctcaacgccctccgtggccctgcaggtcggctccagtctgagatgagctgacttatattgtgcgaggcgggtgggatggacggttcgtgagtgcgttggtgggttccgttcggggcgggaacggggacccaaggtcgttcggtacccggttccgttggggttccacgggcccgaagggcccgtccggcccccgttcgggtcccttaacgtttcccg

SEQ ID NO: 388413 - DNA, 636 bp, Homo sapiens
  misc_feature: GZ8MTXP01C34QC.11.67.G01.1.454.CMB.2.raw
  modified_base (191)..(191): a, c, t, g, unknown or other
  modified_base (218)..(218): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccacctcagcgtctgggacccccggnagagaatcacatctcttgtactggaancagctacaaatagtacggaaagtaacgatgtactaaagttggtatacaaacactcccgtaccccggtaccgaccccctaaactcctacactactaagtaaggaaatacgccacgccggccctcgacggggtccctggccgtacttctcgtcggcgtacgaacgtcgtcggccacctcaacgtccctcccgtcgcctcgcgtacgggtcgggcctaccgtagtcgtaggaggagtggacggtcgttagtaacttaagtttagttgtcgacgtaggcggggtagggtaggtacggtacggtcgtgtggtggtcgtcggtcggttcggttcgggtcgggaacgggaaccggacgtcgttcgtaccggtccgttcggttcgacgaaccgacggcgtccgtcccgttccgtccgttccgtccg

SEQ ID NO: 388414 - DNA, 618 bp, Homo sapiens
  misc_feature: GZ8MTXP01ENWFX.11.67.G01.1.454.CMB.2.raw
  modified_base (270)..(270): a, c, t, g, unknown or other
  modified_base (333)..(333): a, c, t, g, unknown or other
tcagcgagagataccacgaccggtgctcgatttagagtatacatattgggtttggggagctctgagagaggagcccagccctgggatttttcaggttgtttttcattttggtgatcaggactgaacagagagagctcaccatggagtttgggctgagcgtgtcgttttctaggtggctaatttaaaggtgtcagtgtgaggtggagttattgcagtcgtgggggggcttggtgcagccggaggggtccctgagactctcctgtgtggctntggattctagttagcagctacgccatgccgtggtccgccgacgcgccgagggaagggcgtggnggtggtcgtcggtcgtagttaagtcggcccgaccggggagacgaacgactaaactacgtaacgacgacgtacgtcgtacgacggacgggacgacgtcgaccgactactaccgaccgaacgaacgtaactaacgtaccgaacgaacgacgtacgtacggtacgtacgaacgaacgtacgacgacgacgagacgacgacgaccgacgaacgtacgttactacttacgtacgtacgacgacgttaacgtaaccgtacgtaacgtagtacgttacgtcgttaacgtaag

SEQ ID NO: 388415 - DNA, 557 bp, Homo sapiens
  misc_feature: GZ8MTXP01C0R42.11.67.G01.1.454.CMB.2.raw
  modified_base (192)..(192): a, c, t, g, unknown or other
  modified_base (220)..(220): a, c, t, g, unknown or other
  modified_base (244)..(244): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaancagctccaatatcggaagtaacgntgtcaattggtatcaacatcctccccggtacgccccccaaactcctcatctataggaatagccagcgccctcgacggggtccctgggccgattcgtctggctcgaacgtctggcacctcaacgccctccctggccctgcagtcgggctccagtctgaggatgaggctgattagttactgtcagttcctttggactattaaacgtggatgtgtattcggcggtacggacccgacgtaaccgtcgtaaggttcacgccgtaagggcttcggccccttcggtctacctcgtcgttccccaccctcccttcgttaac

SEQ ID NO: 388416 - DNA, 441 bp, Homo sapiens
  misc_feature: GZ8MTXP01AJZKI.11.67.G01.1.454.CMB.2.raw
  modified_base (415)..(415): a, c, t, g, unknown or other
  modified_base (437)..(441): a, c, t, g, unknown or other
tcagcgagagataccacgaccggtgctcgatttagagtatacatattgggtttggggaccccgggcagagaatcaccatctcttgtactggaagcagctccaatatcggaagtaacgatgtcaattggtatcaacatctcccccggtacggcccccaaactcctcatctataggaatagccagcggccctcaggggtccctggccgattctctggctcgaagtctggcacctcagcctcctggcctgcagtgggctccagtctgaggatgaggctgactattattgtgcagcgtgggatgacggtctgagtgctgtggtcttcgggcggagggaccaagctgaccgtctgggtcagcccaaggctcgccccctgggtcactctcgttccccaccctcctcgtatcctctcgctgngcgggctggcaaggcgcatagnnnnn

SEQ ID NO: 388417 - DNA, 619 bp, Homo sapiens
  misc_feature: GZ8MTXP01ATG3E.11.67.G01.1.454.CMB.2.raw
  modified_base (210)..(210): a, c, t, g, unknown or other
  modified_base (214)..(214): a, c, t, g, unknown or other
  modified_base (237)..(237): a, c, t, g, unknown or other
  modified_base (531)..(531): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcggggacccccgggnaganaatcacatctcttgtactggaancagcctaccaaatagtacggaaagtaacgatgtacaagttggtatacaactactcccgtaccccggtaccgaccccctaaactcctacactactaataagaactacgccacggccggccctcgacggggtccctcggccccgtattcgtcgtcggctaacgaacgtcgtcggcctacctcacgtccctccgtcggcctgcgaggtcggcctccgagtcgtaggaggagtggacggtctagtaacgttagtttagttgcgcgtaggtcggtagggtactcggtacggttcgtggngttgtcgttggtcggttcggttcggggcgggacgggaccacggtcgtacggtaacccggtcggtcgggttaccaacggcccgtaacgg

SEQ ID NO: 388418 - DNA, 631 bp, Homo sapiens
  misc_feature: GZ8MTXP01D9YWL.11.67.G01.1.454.CMB.2.raw
  modified_base (206)..(206): a, c, t, g, unknown or other
tcagcgagagataccacgaccggtgctcgatttagagtatacatattgggtttgggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnagagaatcacatctcttgtactggaagcagcctaccaaatagtacggaaagtaacgatgtacaattggtatacaaacactcccgtacccccggtaaccgacccccaaactccctacatactaagtaaggaatacgcccacggccggccctcgacggggtccctcggccccgtattctcgtggctaacgaacgtcgtcggccaccctcacgtccctcccgtcggcctgcgtaggtcggcctccgtagttcgtaggaggtatggacggtcgttagtaacgtttaatttagttggtcgacgtaggtcggtgggtaggtacggtacggtcgtgtggtggtcgttggttcgggttcggttcgggtcgggacgggaccggaacggtcgtcggtaaccggtccggtcgggttcgtaaccgaacccgaaccgg

SEQ ID NO: 388419 - DNA, 528 bp, Homo sapiens
  misc_feature: GZ8MTXP01D93HS.11.67.G01.1.454.CMB.2.raw
  modified_base (434)..(434): a, c, t, g, unknown or other
  modified_base (454)..(454): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggaccccggcagagaatcaccatctcttgtactggaagcagctccaatatcggaagtaacgatgtcaattggtatcaacatcctccccggtacgcccccaaactcctcatctatagatagccagcgcctcgacggggtccctggccccgtattctctcggctacgaagtctggccaccctcacgccctccctcggcctgcagtgggcctcgagtctgagatgagctgactattatgngcagcgtggatgacgtctgngtgcttggtcgttcgtcgggcggacgggccaaggcgtcggtaacccgtcgtcgggttacaacggcccgaacggg

SEQ ID NO: 388420 - DNA, 364 bp, Homo sapiens
  misc_feature: GZ8MTXP01APRO6.11.67.G01.1.454.CMB.2.raw
  modified_base (237)..(237): a, c, t, g, unknown or other
  modified_base (271)..(271): a, c, t, g, unknown or other
  modified_base (362)..(364): a, c, t, g, unknown or other
tcagcgagagataccacgaccggtgctcgatttagagtatacatattgggtttgggaacctatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtntgagtgctgtggtcttcggcggagggaccaagcngaccgtctgggtcagcccaaggctgccccctggtcactctgttccccaccctcctcgtatctctcgctgagccggctggcaaggcgcatgnnn

SEQ ID NO: 388421 - DNA, 435 bp, Homo sapiens
  misc_feature: GZ8MTXP01D4O05.11.67.G01.1.454.CMB.2.raw
  modified_base (304)..(304): a, c, t, g, unknown or other
  modified_base (409)..(409): a, c, t, g, unknown or other
  modified_base (431)..(435): a, c, t, g, unknown or other
tcagcgagagataccacgaccggtgctcgatttagagtatacatattgggtttggggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctcctggcctgcagtgggctccagtctgaggatgaggctgactattatgtgcagcgtgggatgacgtntgagtgctgtggtcttcggcggaggaccaagctgaccgtctgggtcagcccaaggctcgcccctggtcacgtctcgttcccaccctcctcgtactctctcgctgngcgggctggcaaggcgcatagnnnnn

SEQ ID NO: 388422 - DNA, 539 bp, Homo sapiens
  misc_feature: GZ8MTXP01D7FZM.11.67.G01.1.454.CMB.2.raw
  modified_base (196)..(196): a, c, t, g, unknown or other
  modified_base (224)..(224): a, c, t, g, unknown or other
  modified_base (404)..(404): a, c, t, g, unknown or other
  modified_base (447)..(447): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaancagctcaatatcggaagtacgatgtcaattggtatcaacatctccccggtacggcccccaaactcctcatctataggaaatagccagccgccctcgacgggggtccctgggccgattctctggctcgaagtctggccacctcaacgcctcccgtggcctgcagtcgggctcagtctgagntgaggctgactattattgtgcagcggggtgggagtggacggtngagtgcttggtggtcgttcggcgggaaggacaggcttggaccgtcgttacgggttcacgcccaaggcctcgccccttcggtccgttcttccg

SEQ ID NO: 388423 - DNA, 573 bp, Homo sapiens
  misc_feature: GZ8MTXP01DINVX.11.67.G01.1.454.CMB.2.raw
  modified_base (314)..(314): a, c, t, g, unknown or other
  modified_base (561)..(561): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtcttttctaggtggctaattttaaaaggtgtcagtgtgaggtggagttattgcaggtcgtggggggggcttggtgcagccggagggggtccctgagactctcctgtgtaggctctggattctagtttagcagctaacgccatcgacctgggtcccnccgaggctccggaaggggaaggggctgggaggttgggtctcggcttaagttaagtggcccccgagggtaggcaaagacaataactcgcagacgttccgagcgagggcccgatgccacatcaccagacaacacttaccaagaagacgctacgggtaccctgaaccaaagcggaacagccagacgacgaccgacgaacgaaccggtcttatattacgtgcgaccagttaaactcctacaagtatagttntccgaagttggg

SEQ ID NO: 388424 - DNA, 544 bp, Homo sapiens
  misc_feature: GZ8MTXP01D0DW1.11.67.G01.1.454.CMB.2.raw
  modified_base (189)..(189): a, c, t, g, unknown or other
  modified_base (209)..(209): a, c, t, g, unknown or other
  modified_base (416)..(416): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctnagcgtctcgggacccccggnagagaatcaccatctcttgtactggaagcagctcaatatcggaagtaacgatgtcaattggtatcaacatcctccccggtacgcccccaaactcctcatctataggaatagccagcgccctcgagggtccctggccccgattctcgtgctacgaagtctggccacctcacgcctcccgtgcctgcagtggctccagtctgaggatgngctgacttattagttgtgcagcggtggatggtacggtctgagtgcgttggtcggttcgttcgggcgggaaggggcccaaggtccgtaggaacccgttcgtgggggttccaacgggccccgtaaacggg

SEQ ID NO: 388425 - DNA, 574 bp, Homo sapiens
  misc_feature: GZ8MTXP01C54VA.11.67.G01.1.454.CMB.2.raw
  modified_base (197)..(197): a, c, t, g, unknown or other
  modified_base (249)..(249): a, c, t, g, unknown or other
  modified_base (443)..(443): a, c, t, g, unknown or other
  modified_base (464)..(464): a, c, t, g, unknown or other
  modified_base (486)..(486): a, c, t, g, unknown or other
tcagcgagagataccacgaccggtgctcgatttagagtatacatattggggtttgggggggttgagaagacaggactcaggacaatctccagcatggccagcttccctctcctcttcaccctcctcactcactgtgcagggtcctgggcccagtctgttctgactcagccaccctcagcgtctcggggacccccggnagagaatcaccatctcttgtactggaagcagctaccaatatcggaataacgntgtcaaattggtatcaacatcccgtccccggtacgcccccaaactcctcatctataggaatagccagccggccctcgacgggggtcccctgggccgtattctcgtggctcgaacgtctaggcacctcaacgccctccgtggccctgcaggtcgggctccagtctgaggatgagctgacttatattgtgcgaggnggggtgggagtgacggtgtgngtgtcgtggtggtcgttcgggngggaacgggacgaagcgttacggtaccgtcggttcgggttcgacggccccgaaggtccgtcgcccccgttcggtccgttccgttcccg

SEQ ID NO: 388426 - DNA, 631 bp, Homo sapiens
  misc_feature: GZ8MTXP01DZSZX.11.67.G01.1.454.CMB.2.raw
  modified_base (195)..(195): a, c, t, g, unknown or other
  modified_base (271)..(271): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctaccaatatcggaagtaacgatgtcaaattggtatcaacatccnccccggtacggcccccaaactcctcatctataggaaatagccagccggccctcgagggtcctccgtcgacgttacttcgtcgcgtccgtaacgacgttcgcgaccctaccctaaccgcccgtcccgttccggtccgtccgtcgacggtcggggtcggtccctacgtacgtcggtaggagtgtaggacgtcgtacgtaatttattagtgtacgcggtaggggtcggggtaggtaggtacggttacggtgtaggtggtcgtcggttgggttcggttccgggtcggggaacgggtacggaacgcgttcgaccgtcccgttcggttcgcgaaccgacgcgtcgccccgttccgtcgccgttccg

SEQ ID NO: 388427 - DNA, 497 bp, Homo sapiens
  misc_feature: GZ8MTXP01B73ZB.11.67.G01.1.454.CMB.2.raw
  modified_base (478)..(478): a, c, t, g, unknown or other
  modified_base (483)..(497): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtcagatattgcactggtgcaactgctacgacgcctactattatcaccacatggacgtcgtggggacaaagggaccacggtcatcgtctcctcacgccctccaccgaacggcccagtccggtccttcccccgtggcccccacccctcctaccaaacgcgacccaccctcggtcgggggccacgacggccggccccgtggggcctcgccgtggacaacggtaccttacgttccgtatctctcgctgaggcgggcgtgggacgaacggcgacngtagnnnnnnnnnnnnnnn

SEQ ID NO: 388428 - DNA, 521 bp, Homo sapiens
  misc_feature: GZ8MTXP01DZBZH.11.67.G01.1.454.CMB.2.raw
  modified_base (192)..(192): a, c, t, g, unknown or other
  modified_base (220)..(220): a, c, t, g, unknown or other
  modified_base (514)..(514): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaancagctccaatatcggaataacgatgtcaaattggtatcaacatctccccggtacggcccccaaactcctcatctataggaatagccagcggccctcaggggtccctggccgattctctggctcgaagtctggcactcaagcctccctggcctgcagtgggctccagtctgagatgaggctgactattatgtgcagcggtgggatgacggtctgagtgctgtgtcgttcgggcggtaagggccaaggcttggaccgtcgttgggttcagcccgaaggctcgccccgttcggtccncgttccg

SEQ ID NO: 388429 - DNA, 372 bp, Homo sapiens
  misc_feature: GZ8MTXP01A60MY.11.67.G01.1.454.CMB.2.raw
  modified_base (237)..(237): a, c, t, g, unknown or other
  modified_base (368)..(372): a, c, t, g, unknown or other
tcagcgagagataccacgaccggtgctcgatttagagtatacatattgggtttgggaacctatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtntgagtgctgtggtcttcggcggagggaccaagctgaccgtcctgggtcagcccaaggctgccccctcggtcactctcgttccccaccctcctcgtatctctcgctgacgccgggctggcaaggcgacatgnnnnn

SEQ ID NO: 388430 - DNA, 741 bp, Homo sapiens
  misc_feature: GZ8MTXP01C49L7.11.67.G01.1.454.CMB.2.raw
  modified_base (211)..(211): a, c, t, g, unknown or other
  modified_base (215)..(215): a, c, t, g, unknown or other
  modified_base (238)..(238): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtcgtcggggacccccgganaganaactcactatctctgtacgagancagctactaatacgtacggaagtaacgatacgtacaagttgtaactacaactacgtccccgtaccccggtaacccgaccccctaaactcctactactacgtaagtaaggtaactacgaccgacggcccggtaccgtcggaccggggtccctacggtccccgtacttcgtcgtcggccgtaacgtacgtcgtacgcctacccgtcgaccgtcccgtccgtcggcctgacgtacgggtccggaccttaccgtacgttcgtaggacggtagtacggtacggtacgttacgttaaacgtttagtttagttcgggtacgtacggtacgggtacgggtacgggtacggtacgggtacggttacggttcggtacggttcggttcggttcgggttcgggtttccgggttaccggggtaccggggttaaccggggttaaccggttaacggtaaccggtaccggtaacccggtacccgggtcgggttaccggtaaccggaacccggtaaccgg

SEQ ID NO: 388431 - DNA, 544 bp, Homo sapiens
  misc_feature: GZ8MTXP01A210J.11.67.G01.1.454.CMB.2.raw
  modified_base (208)..(208): a, c, t, g, unknown or other
  modified_base (472)..(472): a, c, t, g, unknown or other
  modified_base (475)..(475): a, c, t, g, unknown or other
  modified_base (529)..(529): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctaccaatatcggaagtaacgatgtcaattggtatcaacatcctccccggtacgacccccaaactcctcatctataggaatagcccagccggccctcgacggggtcccctggcccccgattctcgtggcctacgaacgtctggccacctcacgccctccctgggccctgcaggtcgggctccagtctgaggatgaggctgacttattagttgtgcagcggtgggatgacggtntgngtgcgttggtcggttcgttcgggcggacgggcaggcgtgccgtcgtgggttccncggttcccgaacggg

SEQ ID NO: 388432 - DNA, 691 bp, Homo sapiens
  misc_feature: GZ8MTXP01B59JJ.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgtcttttctgtggctaattttaaaaggtgtcagtgtgaggtggagttattgcgagtcggtggggggggcttggtgcgagccggagggggtcctgagactctcctgtgtaggctcgtggattctagttagcagtctacgcatcgaccgtggtccgcgaggctccgaagggggaacgggcgtggacggttgggtcgtcggtacttaagttaagtcgggaccccccgtagggtggaccaaaggtaccaaagttaccgtaacgacgaaggtacggttcccggtagcggaacggggcccgtaagtcgaccaaccctaattcccgaccgaaacggacgtaaactaaccgttaccccgaaagggtaaaacgccggtacccttacgggggtaaaccccttaggaaaccgtaaaaggttcggaacgacgtacccgaaggacgtacggacccgaccggaacgaaccgggtaccgttaattacttacgtggtacgaccgaaaggaaaccttccggactaagtaacttagttcgaaccttggtcggg

SEQ ID NO: 388433 - DNA, 576 bp, Homo sapiens
  misc_feature: GZ8MTXP01BCQMF.11.67.G01.1.454.CMB.2.raw
  modified_base (536)..(536): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttattttaaaaggtgtccagtgtgaggtggagttattgcagtcgtgggggggcttggtgcagccggagggggtccctgagactctcctgtgtaggctctggattcagtttagcagctacgccatcgacctgggtcccgccgaggctccgaaggggaaggggcgtgggaggttgggtcgtcggtcttaattaagtcggccccgacgggtggacaaagacaaattacctcgcaaggacggtcccgtgcgacggggccagtgcaccgatcctacagacgaacaacttcccaagaacgacgtctacggggtacctagacaaagtgacagcctagacgacgccgacgacgaacgccgttatacttacgngtcgcgagaaactccgtacaagtatagttcgcaacgtggg

SEQ ID NO: 388434 - DNA, 728 bp, Homo sapiens
  misc_feature: GZ8MTXP01C9UZP.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggtcttattttaaaaggtgtccagtgtgaggtggagttattgcaggtcggtgggggggggcttgggtgcgaggccggagggggtccctgagactctcctgtgtaggctctggtattctagttagcagctacgccatcgaccgtcgggtccgccgaggcctaccggagggggaacgggggcgtgggagggttcggggtcgtcggtacttaagttaagcgggaccccgacggggtggacaaacggaactaaacgttaacctaacggcgaacgggtaacggttcccggtgaccgggacggggacccgtagtacgacccacctaactcccgtacccgaaagaacgtaacctaaacgttaccccgaaaagaaaccggaccgtaccgttacggtaaccgttacggaacctaaaacgtcggaaaccacggcccgtaaggacggacggacccgacggaaccggaaccggtacccgttaaattacgttacgtacggtacgaaccgttaacggttaaaccctcccgggtaacctaagtaacttagttcggaaccgttaacgtaacgggg

SEQ ID NO: 388435 - DNA, 624 bp, Homo sapiens
  misc_feature: GZ8MTXP01CHSMP.11.67.G01.1.454.CMB.2.raw
  modified_base (249)..(249): a, c, t, g, unknown or other
  modified_base (307)..(307): a, c, t, g, unknown or other
  modified_base (347)..(347): a, c, t, g, unknown or other
  modified_base (487)..(487): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggctattttaaaaggtgtccagtgtgaggtggagttattgcagtcgtggggggggcttggtgcgagccggagggggtcccngagactctcctgtgtaggctctggattcagtttagcagctacgcatgacctggtcccncaggctccgagggaagggctggagtgggtctcggctatanggccccagggtgcaagcaatactcgcagacgtccgtgcgagggcccgatcgacacctacgtcctacccgaaggacgaactaaacttccccgaagaaacgacgtacctagggtaacccctggaaccaaagttcggaaccgngtcccgtaggaacggacgacccggaaccgaaccgaaccgggtacccgttaaagtactttaaaccgtggttacgacccgaaagttaaaccgttcccggttacccaaggtactacgtttagaacccgttgttaacgggg

SEQ ID NO: 388436 - DNA, 546 bp, Homo sapiens
  misc_feature: GZ8MTXP01BYA8A.11.67.G01.1.454.CMB.2.raw
  modified_base (305)..(305): a, c, t, g, unknown or other
  modified_base (373)..(373): a, c, t, g, unknown or other
  modified_base (397)..(397): a, c, t, g, unknown or other
  modified_base (404)..(404): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgcttttctagtggctattttaaaaggtgtccagtgtgaggtggagttattgcagtcgtggggggggcttggtgcagccgagggggtccctgagactctcctgtgtaggctctggattcagtttagcagctacgccatgacctgggtccncaggctccgagggaaggggctggagtgggtctggctattaatggccccacgggtggcagacaattacncgcagagtccgtgcgagggccgangcaaccntcacagacacactaccgagacgacgctacggtactagaacaagtcggacacgccgtaggacgtacgaccgacgaccgaacggtcgttatacgttcgtcgtcgaccgagaacgtccgtacaagtatacgttcgtcgttcgtgg

SEQ ID NO: 388437 - DNA, 841 bp, Homo sapiens
  misc_feature: GZ8MTXP01A3WGH.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaatttaaaaggtgtccagtgtgaggtggtagttattgcgaggtcggtgggggggggcttgggtgcgaggccggagggggtccctgacgctctcctgtgtaggctcgtggattctagttagcagctacgccagtcgaccgtcgggtcccgccgacggcctaccggaagggggaacggggcgtgggtagggttcgggggtccgtccggtacttaagttaaacgtcgggaccccccgacggggtcggaacgaaacggacctaaaacgttaaccgtaacggccgtaaagggaaccggttcccgggtacgggaccggaacgggggaccccgtaacgtccggacctaacccgtactacccgttaccggaaacggaacgtaaacctaaaccgtttacccccggaaagtaaaccgggaaccgttaccgttaccgggggttaaaccccgttaggaaaacccgtaaaacggttaccgggaaaccgaaccgggttacccggtaagggaacgggtaacccgggaaccccggaaaccggaacccggaacccgggttacccggttaaactttaacgtttaccgtaaccgggtaacggttaacccttaaaaggttaaaccccgttcccggtaacccgtaaagttaaccgttagttaccggaacgttaaccggttaacggggg

SEQ ID NO: 388438 - DNA, 584 bp, Homo sapiens
  misc_feature: GZ8MTXP01AO5YJ.11.67.G01.1.454.CMB.2.raw
  modified_base (311)..(311): a, c, t, g, unknown or other
  modified_base (386)..(386): a, c, t, g, unknown or other
  modified_base (403)..(403): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtcttttctggtggctaattttaaaaggtgtccagtgtgaggtggagttattgcagtcgtgggggggcttggtgcagccggagggggtccctgagactctctgtgtaggctctggattctagttagctagctacgcctatgaccgtgggtcccnccgagcgtccgagggaaggggctggagtggtctcggctagttaagcggccctacggtggacaaagactaaatacncgcaaggtcgtcccggngacgacgggcagtcaccacactaccacgaagacaactaactaccgaagaacgacgcgtacggtaaccgtagaacgaaagtacggacacgtacgaggacgacgacgacgacgaacgtacttatacgttcgtcgtacgaccgaagaccgtcccgactaacgtactagttcgtaacgttcgtgg

SEQ ID NO: 388439 - DNA, 532 bp, Homo sapiens
  misc_feature: GZ8MTXP01CYEGF.11.67.G01.1.454.CMB.2.raw
  modified_base (209)..(209): a, c, t, g, unknown or other
  modified_base (393)..(393): a, c, t, g, unknown or other
  modified_base (462)..(462): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaagcagctccaatatcggaagtaacgatgtcaattggtatcaacatcctcccccggtacgcccccaaactcctcatctataggaatagccagccggccctcgacggggtccctggccccgattctcgtggctacgaagtctggcacctcacgccctccngcctgcagtcggctccagtctgaggatgagctgacttattattgtgcagcgtgggatggtacggtctgngtgcgttggtggttcgttcgggcggttagggccaggcgtcgccgtcgtgggttccaacggcccgtaacgg

SEQ ID NO: 388440 - DNA, 729 bp, Homo sapiens
  misc_feature: GZ8MTXP01D9EY0.11.67.G01.1.454.CMB.2.raw
  modified_base (210)..(210): a, c, t, g, unknown or other
  modified_base (214)..(214): a, c, t, g, unknown or other
  modified_base (220)..(220): a, c, t, g, unknown or other
  modified_base (235)..(235): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtcgtcggggacccccggnaganatcacntctcttgtactggancagctactaatagacggaagtaacgatgtacaagttgtactacaactactcccgtacccccggtaacccgaccccctaaactccctactacttactaagtaacggaactacgaccgacggcccggtcccgtacggtaccggggtcccgtcgggtaccccctactttcgtccgtcggtaccttaaccggtaacgttccgtacggtacccctacccgtccgacccgtcccccgttcccgtcggcccgtcgccggtacgggtcgggtcccttaccgtacggttcgtagggaggtacgtcggacgtcgtagttaacgtttagtttagttggtacgacgtaggtcgggttagggtacgtcggtacggttcgtaggtggttcggtcggttgggttcgggttaccgggtccgggggacgggttaacgggaccgttacgggtccgtaccgggtaacccggttccgggtacgggttaccgtaacccggttaacccggtaacgg

SEQ ID NO: 388441 - DNA, 560 bp, Homo sapiens
  misc_feature: GZ8MTXP01CZLJ7.11.67.G01.1.454.CMB.2.raw
  modified_base (208)..(208): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccacctcagcgtcgtcgggacccccggnagagaatcaccatctctgtactggaagcagctaccaatatacggaagtaacgatgtacaattggtatcaacatcctccccggtacgcccccaaactcctcatctataggaatagccagccggccctcgacggggtcctcggccccgattctctggctcgaagtctggcacctcacgccctcccgtgcctgccgtagtcgggctccagtctgaggatgaggctgacttattattgtgctagcggtgggatggtacggtcgtggaggttgtcgttgggttcggttcgttcgggcggggttaacgggccaagggtcgtacggccgttccgcggggttcaaccggcccgtaacggg

SEQ ID NO: 388442 - DNA, 432 bp, Homo sapiens
  misc_feature: GZ8MTXP01ED968.11.67.G01.1.454.CMB.2.raw
  modified_base (264)..(264): a, c, t, g, unknown or other
  modified_base (276)..(276): a, c, t, g, unknown or other
  modified_base (305)..(305): a, c, t, g, unknown or other
  modified_base (324)..(324): a, c, t, g, unknown or other
  modified_base (409)..(409): a, c, t, g, unknown or other
  modified_base (424)..(424): a, c, t, g, unknown or other
  modified_base (429)..(432): a, c, t, g, unknown or other
tcagcgagagataccacgaccggtgctcgatttagagtatacatattgggtttggggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtcngaggatgaggcngactattatgtgcagcgtgggatgacgtntgagtgctgtgtcgtcggnggaggacagctcgaccgtcgtgggtcagcccaaggcctcgcccctcggcactctcgttccccaccctctcgtactctctcgctgngcgggctggcaggcngatgnnnn

SEQ ID NO: 388443 - DNA, 580 bp, Homo sapiens
  misc_feature: GZ8MTXP01BDL7W.11.67.G01.1.454.CMB.2.raw
  modified_base (196)..(196): a, c, t, g, unknown or other
  modified_base (373)..(373): a, c, t, g, unknown or other
  modified_base (445)..(445): a, c, t, g, unknown or other
  modified_base (472)..(472): a, c, t, g, unknown or other
  modified_base (497)..(497): a, c, t, g, unknown or other
  modified_base (571)..(571): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtcgtcggggacccccggnagagaatcaccatctcttgtactggaagcagctaccaaatagtcggaaagtaacgattgtacaaattggtatacaacatcctccccggtacgcccccaaactcctacatctataggaatagccagccggccctcgacgggggtccctgggccgtattctcgtgctcgaagtctggcnccctcaacgccctcccgtggccctgcaggtcgggctcagtctggaggagtcggaggctagacttattattgngtcgaggcggggtgggatggaccggtntggagtgtcgtgtggtcgttcgggnggaagggaccaggtcgttcggtacccgtcgttcgggttccacggcccgaggtcccgtcggccccttcgggtccnccgttcccg

SEQ ID NO: 388444 - DNA, 633 bp, Homo sapiens
  misc_feature: GZ8MTXP01BA88U.11.67.G01.1.454.CMB.2.raw
  modified_base (208)..(208): a, c, t, g, unknown or other
  modified_base (500)..(500): a, c, t, g, unknown or other
  modified_base (532)..(532): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccggnagagaatcacatctctgtactggaagcagctaccaatagtcggaagtaacgatgtacaattggtatacaaactatccgtcccccggtaaccggccccccaaaactccctacatcctaataggaatagcccagcggcccttcgacggggtccctggcccccgtattctcgtcggcctacggaaacgttccgtcgggaccaccctaccacggtccccctccccgtgggcccttgccaggttcgggcctacccgagtcctagaggatggaaggcttagacgttattaagtttggngacgtggtcggtaggagtcggtacgtcgtggngttcgtcggttgggttcggttccggttacggggccgggttacgggccttaaggtccgtacggtcccggtcggtcgggttaccgaaccggttccccgtaagg

SEQ ID NO: 388445 - DNA, 456 bp, Homo sapiens
  misc_feature: GZ8MTXP01D5CBJ.11.67.G01.1.454.CMB.2.raw
  modified_base (449)..(456): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtcagatattgcactggtggcaactgctacgacgcctactattatcaccacatggacgtctggggcaaagggaccacggtcatcgtctcctcacgcctccacccaagggcccatccggtcttcccccctggcccacccctctccaagacgccaccctcgtgggggcacgcgccggcccgtggctgcctggtcaaggctacttccgtatctctcgctgagcgggcgtggcaagggcgcatagnnnnnnnn

SEQ ID NO: 388446 - DNA, 592 bp, Homo sapiens
  misc_feature: GZ8MTXP01CXH44.11.67.G01.1.454.CMB.2.raw
  modified_base (547)..(547): a, c, t, g, unknown or other
tcagcgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgacaaatggacagcctgagacgccgacgacacggcctatattactgtgaccaagaaactccgtacagtattatcgccacgtggtaggcaacgtcgactaacgaccgtccttaactattacaccacacagtggacgtcgtggggacaaacgggaccacgtctactcgtcctcctcacgcccgtacccgaaccgtaaaccgggcccctacgttcccggtccccttcccccgtacggcccctacccctccctaccgaacgcgccacccgtcggcggggaccncgacggccggcccgtgggcctcgcgtcggactaacggcttaaccg

SEQ ID NO: 388447 - DNA, 595 bp, Homo sapiens
  misc_feature: GZ8MTXP01BHCXG.11.67.G01.1.454.CMB.2.raw
  modified_base (313)..(313): a, c, t, g, unknown or other
  modified_base (386)..(386): a, c, t, g, unknown or other
tcagcgagagataccacgaccggtgctcgatttagagtatacatattggggggggcttggtgcagccgagggggtccctgagactctcctgtgtaggctctggattcagttttagcagctacgccatgacctgggtccgccaggctccgagggaaggggctggagtgggtctcggctattaatggccacggtggcaagacatactacgcagagtccgtgcagggccatgcaccatctccagagacaattcccagaagacgctgtacctgacaaatggacagcctgagacgccgacgacacggcctatattacngtcgaccagaaactccgtacagtatattgccactggtgacaacgtgacctaacgacgtccctaatactttacnccaacgacagtggacgtcgtggggacaaagggacccacggtcaacgtccgtctcctcacgccctaccgaaccgaacgggccctacgtccggtcccttccccgcggccctacccgtcctaccgaagaaccgtccgacctcggcggggaccacgacggttccggcccgtcgggctccgtccgtcggttaccgtaacggttccctttaaccg

SEQ ID NO: 388448 - DNA, 600 bp, Homo sapiens
  misc_feature: GZ8MTXP01ETOR4.11.67.G01.1.454.CMB.2.raw
  modified_base (199)..(199): a, c, t, g, unknown or other
  modified_base (420)..(420): a, c, t, g, unknown or other
  modified_base (448)..(448): a, c, t, g, unknown or other
  modified_base (498)..(498): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagcccaccctcagcgtcgtcggggaccccccggnagagaatcaccatctcttgtactggaagcagctaccaaatagtacggaaagtaacgatgtacaaattggtatcaaacactcccgtacccccggtaccggaccccccaaaacttccctacatactaataaggaaactagccctaaggcccggcccctacgacgggggttcccctgggccgtattcgtcgtggctcgaacgtctggcactcaacgccctccgngcctgctaggtcgggctcgagtctgagngtgagtctagtacttagttattgtgcgacgtggggtggagtgacggttgngagttggcgttggtcggttacggtcgggcgggaaggtacaggtcttcggaccgtcgttgggttcacgccgacggtctccggcccgttcggtcttcgttcccg

SEQ ID NO: 388449 - DNA, 695 bp, Homo sapiens
  misc_feature: GZ8MTXP01DEQCY.11.67.G01.1.454.CMB.2.raw
  modified_base (200)..(200): a, c, t, g, unknown or other
  modified_base (228)..(228): a, c, t, g, unknown or other
  modified_base (318)..(318): a, c, t, g, unknown or other
  modified_base (471)..(471): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagcccaccctcagccgtcgtcggggacccccggnagagaatcaccatctcttgtactggaancagctaccaatagtacggaaagtaacgattgtactaaagttggtatacaaacatccgtcccccggtaccgcccccaaactcctcatctanagaatgccagccgccctcgacggggtccctgggccgtatttctcgtggctacgaacgtcgtggcaccctcaaccgccctccgtcggccctgctaggtcgggctccgagtcgtggaggagtaggaggacttacgtaacttaagtttagttacgnggtacgagggtcggggttaggggtagtacgggtacggtcgtggtacggttggtcgttgggttcgggttcggttccggggcggggaacgggtaaccgttaaacgggtccgttcgggtaaccccgggttccggttaccgggggttccgaacccgggtccccggtaaacgggtcccgttaccccggtcccccggtttaccgggtccccttaacccgtttcccccggg

SEQ ID NO: 388450 - DNA, 548 bp, Homo sapiens
  misc_feature: GZ8MTXP01BKQWF.11.67.G01.1.454.CMB.2.raw
  modified_base (209)..(209): a, c, t, g, unknown or other
  modified_base (402)..(402): a, c, t, g, unknown or other
  modified_base (455)..(455): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtcgtcgggacccccggnagagaatcaccatctcttgtactggaagcagctaccaatagtcggaaagtaacgatgtacaattggtatcaacatcctccccggtacgccctaccaaactcctcatctaataggaatacgccaggccgccctcgacggggtccctcggccgtattctctcggctcgaagtctgggccacctcacgccctcccngcctgcaggtggctccgagtctggagatgaggctagggtacttattattggtncgaggtcgtgggatggacgtctggaacgtgcgttggttggtcgttcgggcgggaggaccaaggcgtgacccggtcgttggggtcaacggcccg

SEQ ID NO: 388451 - DNA, 560 bp, Homo sapiens
  misc_feature: GZ8MTXP01AI07A.11.67.G01.1.454.CMB.2.raw
  modified_base (209)..(209): a, c, t, g, unknown or other
  modified_base (485)..(485): a, c, t, g, unknown or other
  modified_base (489)..(489): a, c, t, g, unknown or other
  modified_base (512)..(512): a, c, t, g, unknown or other
  modified_base (546)..(546): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtctcgggacccccggnagagaatcaccatctcttgtactggaagcagctaccaatatcggaagtaacgatgtcaattggtatcaacatcctccccggtacgacccccaaactcctcatctatagaatagccagccggccctcgacggggtccctggcccctattctcgtggccttacgaagttcgtgggccctacctcacgtccctcccgtcggcccttgccaggtcgggcctcagtctgaggatggagctagacttatttatgtagctaggtcgtggggtatggtacggtntagngtgcgttggtgttcgttcggggnggacgggttcaagctcgccggtccgtgggttccncgaacccgaacggg

SEQ ID NO: 388452 - DNA, 719 bp, Homo sapiens
  misc_feature: GZ8MTXP01CNM3G.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtcagtgtgaggtggagttattgcaggtcgtggggggggcttgggtgcagccggagggggtccctgagctctctgtgtaggctctggattctagttagcagctacgccatgaccgtggtcccgcgacggcctccgaagggggaacgggggcgtgggaaggttcggggtcgttcggacttaattaaagtcggccccacggggtgacgtaaagaccaaattaacgtaaccggcaaaggaacggttccccggtggaccgaacggggcccgacgtcgaccaacccattcccgacccgaagaacgaactaaaccgttaccccaaagaaacgaccgtacgttaccgggttaaccgtacgaacctaaacgtcggaaaccgacgtcccgtaggaacggaccgaacccggaaccggaaacccgaaccgggtacccgttaaagttaacgtttaacgtacgggttacggacccaaacgttaaaaaccgttccccggtaaccgtaacggttaacttagttacgtccgttaaccggttaacgggg

SEQ ID NO: 388453 - DNA, 700 bp, Homo sapiens
  misc_feature: GZ8MTXP01CD805.11.67.G01.1.454.CMB.2.raw
tcagcgagagataccacgaccggtgctcgatttagagtatacatattgggtttggggagctctgagagaggagcccagccctgggattttcaggttgttttcatttggtgatcaggactgaacagagagagctcaccatggagtttgggctgagctggtcttttttcttgtggtcttaattttaaaaggtgtccagtgtgaggtggagttattgcaggtcggtggggggggtcttgggtgcgaggccggagggggtccctgagctctctgtgtagctctggtattcagttagcagctacgcatcgacctgggtcccgcgaggcctccgaagggggagggctgggaggtgggtctcggctaagttagcggccccagggtggacaaagacaaataacctcgacaaggtacgtcccgtggaccgaggggcccgatcgaccaccacttcccaccgaacgaaacggaacctaaaccgtttaccccgaaagaaacgtaccgaccgttaacggggtaacccttacggaaaccaaaacgtcgggaaaccaccgggtaccgtaacgggaacggtaccggaccccggtaaccggaaaccggaacccgggtaacccgtttaattaacgttaccgttacggtacggacccgttaaacgaaaaccttcccggtaacctaaggtacttaagttcgtaacgttccggttaagggg

SEQ ID NO: 388454 - DNA, 581 bp, Homo sapiens
  misc_feature: GZ8MTXP01E0JM7.11.67.G01.1.454.CMB.2.raw
  modified_base (194)..(194): a, c, t, g, unknown or other
  modified_base (245)..(245): a, c, t, g, unknown or other
  modified_base (267)..(267): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctccaatatcggaataacgntgtcaaattggtatcaacatcnccccggtacgcccccaaactcctcatctataggaatagccagcgccctcgacgggggtcccctggccgattctctggctcgaacgtctggcacctcaacgccctcccgtggcctgcaggtcgggctccagtctggaggatgaggctgactattattgtgcaggcggtgggtagtggacggtcgtgagtgcgtggtggttcgttcgggcgggtaacggaccgttaaggcgttcggacccggttccgttcggggttcaccggtaacccgaacgggtcccgtccggccccccgttcgggtcccttaaccgtttcccg

SEQ ID NO: 388455 - DNA, 548 bp, Homo sapiens
  misc_feature: GZ8MTXP01DOL2I.11.67.G01.1.454.CMB.2.raw
  modified_base (210)..(210): a, c, t, g, unknown or other
  modified_base (376)..(376): a, c, t, g, unknown or other
  modified_base (461)..(461): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtctcggggacccccggnagagaatcaccatctcttgtactggaagcagctccaatatcggaagtaacgatgtcaaattggtatcaaacactcctcccccggtacgcccccaaatcctcatctataggaatagccagccggccctcgaggggtccctggccccgattctcgtgctacgaagtcnggccactcacgccctcctgcctgcagtggctcagtctgagatgaggctgacttattagttgtgcaggcgtgggatggacgtctgngtgcgttggtacggttcgttcgggcgggttacggaccaggtccgtcggaacccggttccgtggggttaccaacggccccgtaacggg

SEQ ID NO: 388456 - DNA, 617 bp, Homo sapiens
  misc_feature: GZ8MTXP01CNB52.11.67.G01.1.454.CMB.2.raw
  modified_base (237)..(237): a, c, t, g, unknown or other
tcagcgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatcncagagacattcccagagacgctgtacctgcaaatggacagcctgagacgccgacgacacggcctatattactgtcgaccagaaactccgtacagactattcgcctacgtggtcgactaacgtgacctaacgaccgtcctaactattacacaccacagtggacgtcgtaggggacgaaacgggacctacggtacactcgtctcctacacgccctaccgacccgtaacgggcccctacgtcccggttcccttcccccgtcggtcccctacccctcccgtaccccaaacggaaccgcccgaccgtccggttcgggggaccacgacggccggccccgtggggccgtcggcccgtacggttaccgtaacggttaactttaacccg

SEQ ID NO: 388457 - DNA, 540 bp, Homo sapiens
  misc_feature: GZ8MTXP01DDFA7.11.67.G01.1.454.CMB.2.raw
  modified_base (511)..(511): a, c, t, g, unknown or other
  modified_base (523)..(523): a, c, t, g, unknown or other
tcagcgagagataccacgaccggtgctcgatttagagtatacatattgggtttggggggttgagaagacaggactcaggacaatctccaacatggcctggtctcctctcctcctcactctcctcgctcactgcacagggtcctgggcccagtctgcgctgacgcagccgccctcagtgtctgggccccagggcagaggtcgccatctcctgcactggtccacctccaatatcggggccgttatggtatgctctggtatcaaacaacgtccaggaatcggcccccaaactcctcatctatgctgacaacaatcgaccttcaggggtccctgacccggttctcgtcggcctccaagtctcggccttcccttcccggccttcccgttgggcccatccacgtggggctcgagctgacgatgaggctgattctactgtctgtctatgacgacgacctacagtcgttccggttttcggcggtagggactagctcgaccgtcttagtcagcccaggcncgcccctcgtcncttctcgttcccgtccc

SEQ ID NO: 388458 - DNA, 571 bp, Homo sapiens
  misc_feature: GZ8MTXP01EXPW1.11.67.G01.1.454.CMB.2.raw
  modified_base (196)..(196): a, c, t, g, unknown or other
  modified_base (438)..(438): a, c, t, g, unknown or other
  modified_base (462)..(462): a, c, t, g, unknown or other
  modified_base (465)..(465): a, c, t, g, unknown or other
  modified_base (516)..(516): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaagcagctaccaaatatcggaaagtaacgatgtcaaattggtatcaaacatcctccccggtacggaccccccaaactcctcatctaataggaaatagccagccggccctcgacgggggtccctggccgtattctctggctcgaacgtctggcacctcaacgccctccctggcctgcagtgggctccagtctggaggatgaggctgtactattattgngtcaggcgggtgggatggacggtntgngtgcgtgtggtcgttcgggcgggaagggaccaaggcgttcggaccgttcgnggggttcacggccccgaaggtcctccggcccccgttcggtccttaaccgttcccg

SEQ ID NO: 388459 - DNA, 598 bp, Homo sapiens
  misc_feature: GZ8MTXP01B7F7I.11.67.G01.1.454.CMB.2.raw
  modified_base (410)..(410): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggcttattttaaaaggtgtccagtgtgaggtggagttattgcaggtcgtggggggggcttgggtgcgagccggagggggtccctgagactctcctgtgtaggctctggattctagtttagcagctacgccagtcgaccgtggtcccgcaggcctccgaggggaagggcgtgggaggtcgggtcgtcggtcttagttaagcggccccgacgggtgacaagacaatacctcgcgagacgtccgngcgacgggccatcgcacgactctaccgagacgacaacgttacccaagaaacgacgccgttacgggtaaccctagaaccgaaagtcggaacacgccgtagacgacggcccgacgacgaacggcttaatcgttaccgtgtcgaccttagaaaccgtccgtaccaaggtactagttcgtccgaacgttcgg

SEQ ID NO: 388460 - DNA, 533 bp, Homo sapiens
  misc_feature: GZ8MTXP01DK9FG.11.67.G01.1.454.CMB.2.raw
  modified_base (340)..(340): a, c, t, g, unknown or other
  modified_base (372)..(372): a, c, t, g, unknown or other
  modified_base (482)..(482): a, c, t, g, unknown or other
tcagcgagagataccacgaccggtgctcgatttagagtatacatattgggtttggggggtgagaagacaggactcaggacaatctccagcatggccagcttccctctcctcctcaccctcctcactcactgtgcagggtcctgggcccagtctgttctgactcagccaccctcagcgtctggggaccccccgggcagagaatcaccatctcttgtactggaagcagctccaatatcggaagtaacgatgtcaattggtatcaacatctccccggtacggcccccaaactctcatctataggaatagccagccggccctcagggggtccctgcgattctcnggctcgaagtctggcacctcaacgcctcccgngcctgcaggtgggctccagtctgaggatgaggctgactattatgtgcaggcgtggggatgacggtctgagtgcgtcgtggtaccgtcgggtcgggaagggcccaaggtcnggaccccgtcgcgggttcacgccaacggctcgcccccgttcgtccaacgtc

SEQ ID NO: 388461 - DNA, 793 bp, Homo sapiens
  misc_feature: GZ8MTXP01BXG7O.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcagtcggtggggggggcttggtgcagccggagggggtccctgagactctctgtgtagctctggattctagttagcagctacgccatcgaccgtcgggtcccgccacggcctccggaggggaacgggggctggggaggttcggggtctcggtacttaagttaaagtcggggacccccgtacggggttggaccgaaacggactaaaacgttaaccgtaaccggacaaacgggtacggttccccggtagggacccggaacggggggacccctagttaccggaccctaaaccccgacgtttcccctaacccgaaacggtaacggaaaccctaaaccgtttacccccgaaaaggaaaccggtaaccgtacccgttacggggtaaacccgttacgggaaaccctaaaaggttacggggaacccaacggaccccgttaggaaacggtaacccgggacccggaacccgaaccggtaaccggggtaacccttaaggtttaaactttaccgtacggttaccgaacccgttaaacggaaaaccgttccccggtaccaaggtacttagttaccggaacccttaacgggttcggg

SEQ ID NO: 388462 - DNA, 595 bp, Homo sapiens
  misc_feature: GZ8MTXP01CUVDA.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggcttattttaaaaggtgtccagtgtgaggtggagttatgcagtcgtgggggggcttgggtgcaggccggagggggtccctgagactctcctgtgtaggctctggattcagttagcagctacgccatcgaccgtggtcccgcgaggcctccgaggggaagggcgtgggaggtgggtcgtggcttaagttaagtcggccccacgggtggactaaagaccaaattactaacgcagacgtccgtgcgagggcccagtcgccacatcaccagacgaacaactcccagaacgacgctacgggtacctggaaccaaagtcgacacgcctaggacgacgacccgaacgaccgaacgggtccttatacttacgtacggtcacccgagaaaccgttcccgacctaaggtaacttgttcgaacgttaacggttgggg

SEQ ID NO: 388463 - DNA, 635 bp, Homo sapiens
  misc_feature: GZ8MTXP01BFVGE.11.67.G01.1.454.CMB.2.raw
  modified_base (575)..(575): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttattttaaaaggtgtccagtgtgaggtggagttattgcaggtcggtggggggggcttgggtgcagccggagggggtccctgagactctcctgtgtaggctcgtggtattctagttagcagctaacgccagtcgaccgtcgggtcccgccgacggcctaccggagggggaacgggggcgtagggaggttggggtcgtcgggtacttaagttaagtcggccccgacgggtggacaaagacaagtaacctcgcaggtcgtccgtgcgacgggccatcgccaccgatcctacaagacgaacactacccgagaacgacgtctcggtacctgaccaaaagtcgggaaccaggtcccgtagaacggacggcccggaaacgcggaaccggtaccttatactttaaccggngtacgaccgttaaacgttaacctcccgtacgtaagtacttacgttacgccgttaagtggg

SEQ ID NO: 388464 - DNA, 771 bp, Homo sapiens
  misc_feature: GZ8MTXP01AKBH5.11.67.G01.1.454.CMB.2.raw
  modified_base (211)..(211): a, c, t, g, unknown or other
  modified_base (238)..(238): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcacgcccaccctcagcgtcgtcggggaccccggnagagaatcaccatctcttgactggaancagcctacaatagtacggaaagtacgatgtacaagttggtatcaaactctccgtaccccggtaccgaccccctaaactccctcacttactaagtacgaatacgacccacggcccggtccctcggacgggggtcccctgggacccccttagttccgtcgtcggtcctaacggaacgttccgtcgggacccaccgttccaccgggtcccctcccggtcgggtcccttcgaccgtacgggtcgggtacccttccgtaacggttccggtagggacgggtagtacggggacggtacgttacggaaactttaagttttaggttcggtacgtaccggtacgggttcgggttagggggtaacggttcgggtaacccggggttcgttagggtaggggttcgtccgggtttacggggtttcgggggttacgggtttaccgggggacgggggttaaccggggaccgttaacggggtcccggtaccggggtcccggtttaccgggtccgggggttacccaaccggggttccccgttaacccgggg

SEQ ID NO: 388465 - DNA, 468 bp, Homo sapiens
  misc_feature: GZ8MTXP01BGUEH.11.67.G01.1.454.CMB.2.raw
  modified_base (312)..(312): a, c, t, g, unknown or other
  modified_base (337)..(337): a, c, t, g, unknown or other
  modified_base (397)..(397): a, c, t, g, unknown or other
  modified_base (456)..(456): a, c, t, g, unknown or other
  modified_base (459)..(459): a, c, t, g, unknown or other
  modified_base (461)..(468): a, c, t, g, unknown or other
tcagcgagagataccacgaccggtgctcgatttagagtatacatattgggtttggggacccccgggcagagaatcaccatctcttgtactggaagcagctccaatatcggaagtaacgatgtcaattggtatcaacatcctcccccggtacggcccccaaactcctcatctataggaatagccagcggccctcaggggtccctggccgattctctggctcgaagtctggcacctcacgccctccctggcctgcagtgggctccagtctgaggatgaggctgactattatgtgcaggcgtgggatggacggtntgagtgcgttggtggtcgttcgggnggagggaccaagctcgacccggtcgtggggcaggaccccagggcctcggccccctcggcncgttctcgttccccgctcctcgtactctctcgctgggacgcgggctgggcaagggccgngangnnnnnnnn

SEQ ID NO: 388466 - DNA, 817 bp, Homo sapiens
  misc_feature: GZ8MTXP01B55M9.11.67.G01.1.454.CMB.2.raw
  modified_base (211)..(211): a, c, t, g, unknown or other
  modified_base (215)..(215): a, c, t, g, unknown or other
  modified_base (223)..(223): a, c, t, g, unknown or other
  modified_base (227)..(227): a, c, t, g, unknown or other
  modified_base (235)..(235): a, c, t, g, unknown or other
  modified_base (239)..(239): a, c, t, g, unknown or other
tcagcgagagataccacgaccggtgctcgatttagagtatacatattgggtttggggcagcttcaactgtgggttgagaagacaggactcaggacaatctccagcatggccagccttccctctcctcctcaccctcctcactcactgtgcagggtcctgggcccagtctgttctgactcagccaccctcagccgtcgtcgggacccccggnaganactcactntctntgactgancacnctacaatacgtacggaagtacgatcgtactaagttgtactacaactaccgtcccgtaccccggtacccgacccctaactcctactactactagaacgaactacgccgacggcccggtacccgtacggtaccggggtcccgtcggtaccccgtacgttcgtcgtcggtccgtaacggtacggtccgtcggtaccctacccgtccgaccgtccccgttcccgtcggtcccgtacggccggtacggggtccgggtacccttaccggtacggttacggtagggaacgggtacgttacgggtacgggttacgttaacggttaacggtttaagttttacggttcgggtacggtaccgtaggggttcgggttaggggtaacggttcggggtaccgggttacggttacgggtagggtttcggttccgggtttcgggggttacccgggtttaccggggttaccggggggaaccgggggttaaaccggggttacccggttaacggggttcccggttaccccggggttaaccccgggttccggggttacggggttaccccgaacccggggttaaccccggtaaccgggg

SEQ ID NO: 388467 - DNA, 569 bp, Homo sapiens
  misc_feature: GZ8MTXP01DRDDM.11.67.G01.1.454.CMB.2.raw
  modified_base (209)..(209): a, c, t, g, unknown or other
  modified_base (422)..(422): a, c, t, g, unknown or other
  modified_base (458)..(458): a, c, t, g, unknown or other
  modified_base (475)..(475): a, c, t, g, unknown or other
  modified_base (479)..(479): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgacctcagccaccctcagcgtctcgggacccccggnagagaatccaccatctcttgtactggaagcagctaccaattatcggaagtaacgatgtcaaattggtatcaaacactccgtcccccggtacggcccccaaactcctcatctataggaatagccagcgcctcgacggggtcctcggcccattctctggctacgaagtctggccacctcacgcctcctggcctgccagtcgggctaccgagttcngaggatgaggctaggactttattagttgtgcgacgnggtggagtgtaccggtntagngtgtcttggtcgggttcgttcgggcgggttaacgggccaaggccgtacggcccggttccgtggggttacccaacggttcccgtaaccggg

SEQ ID NO: 388468 - DNA, 632 bp, Homo sapiens
  misc_feature: GZ8MTXP01BT9WI.11.67.G01.1.454.CMB.2.raw
  modified_base (553)..(553): a, c, t, g, unknown or other
  modified_base (582)..(582): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtctttttcttgtggcttaattttaaaaggtgtccagtgtgaggtggagttattgcaggtcggtgggggggggtcttgggtgcaggccggagggggtccctgagactctcctgtgtaggctctggtattctagtttagcagctacgcatcgaccgtgggtccgccgaggctccgaggggaagggctgggaggtgggtcgtcggacttacgttaagtcggacccccgacgggtggaccgaaaggaccaaacgttaccgtaacggacctaaagggtacggtcccggtgggaccgacgggggccctagtcgaccacccattcccgaccgaagaacgtactaaaccttacccgaagaacgacgtacctgggtaccctgaccaaagtggacacgcctaggnacggccgacgcgaacggcttatacttcgngtcgaccgagaaccttccgacaagtactacgtttcaaccgttaagttggg

SEQ ID NO: 388469 - DNA, 789 bp, Homo sapiens
  misc_feature: GZ8MTXP01CSZCR.11.67.G01.1.454.CMB.2.raw
  modified_base (189)..(189): a, c, t, g, unknown or other
  modified_base (209)..(209): a, c, t, g, unknown or other
  modified_base (279)..(279): a, c, t, g, unknown or other
  modified_base (678)..(678): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcacgccaccctnagcgtcgtcgggaccccggnagagaatcacatctctgtactgaagcagcctaccaaatagtacggaaagtaacgatgtacaagttgtaancaaactacgtcccgtacccccggtaccgacccccctaaatccctacaacttcctaaagtaacggaaacttacgcccgaacgggtcccggtccccttacggaaccgggggttcccctggggtacccccccgttatttccgtcggtacgggtcccttaaaccgggtaacggttcccggttacgggcccctaaaccccgtttaccgaaccccggttccccccgtaccccggtttcggggccccgtttcggacccggtaacggggttccgggggtaccctacccggtaaaggtttccgtaggggaaccggtagttacgggacggttaccgttagttaaaccggtttaattttacggtcgtacggacgtacgggtcggttagggaacgttcggtaaccgggttntgggtaggtcgtccggttgggttccggttcggtacgggggacgggttaacgggaccgttaagtccggtacggtaacccgtccggtggggttaccctaacggcccgtaacgg

SEQ ID NO: 388470 - DNA, 638 bp, Homo sapiens
  misc_feature: GZ8MTXP01DZTSV.11.67.G01.1.454.CMB.2.raw
  modified_base (212)..(212): a, c, t, g, unknown or other
  modified_base (291)..(291): a, c, t, g, unknown or other
  modified_base (540)..(540): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagccgtcgtcggggacccccggnagagaatcaccatctcttgtactggaagcagctaccaaattagtacggaaagtaacgatgtacaaagttggatcaaacnctccccgtacccccggtaccgacccccaaactccctacatcctaataggaactacgccgaacgccggtccctacgacggggtccctggcccccgtattcgtcgtcggcctaacgaagtccgtcggcctaccctcaccgtccctcccgtggccctgcgacggtcgggcttccgaagtctaggaggtaatggacgtcgtgtaacgtttatttagttgtcgacgaggtcgggttggaacttggaaccggttntgggtagtcggtgttgggtcgggttcgtcggggcgggaaacgggccaaggtcctacgggtaacccgtcggtagggacctaaccggaacccgtaaccgg

SEQ ID NO: 388471 - DNA, 707 bp, Homo sapiens
  misc_feature: GZ8MTXP01DP1BV.11.67.G01.1.454.CMB.2.raw
  modified_base (212)..(212): a, c, t, g, unknown or other
  modified_base (216)..(216): a, c, t, g, unknown or other
  modified_base (245)..(245): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtcgtcggggacccccgganaganaactccactatctcttgtacgtaggaacncagctaccaatacgtacggaagtaacgtatgtactaagttgtactacaactacgtcccgtaccccggtaccgaccccctaaactcctactactactaagtaagaactacgaccgacggccggtcccgtacggtaccggggtccgtcggtcccgtacttctcgtcgtccgtaacgtacgtcgtcgacctaccctcgaccgtccctccgtcggtccctcggcgtacggtcggtcctaccgtacgtcgtaggaggtacgtacggacgtacgttacgttaacgtttagtttagttcggtcgtacgtacggtcgggttagggtacgttcgggtacggttcgtggtaggtcggtcggttgggttcgggttccggttaccgggggacgggttaaacgggaccgttaacgggtccggttaccggtcccggttccgggtacgggttaccgtaacccggcccggtaaccggg

SEQ ID NO: 388472 - DNA, 612 bp, Homo sapiens
  misc_feature: GZ8MTXP01EECQ7.11.67.G01.1.454.CMB.2.raw
  modified_base (210)..(210): a, c, t, g, unknown or other
  modified_base (496)..(496): a, c, t, g, unknown or other
  modified_base (518)..(518): a, c, t, g, unknown or other
  modified_base (522)..(522): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtcgtcgggacccccggnagagaatcaccatctcttgtactggaagcagctaccaaattatcggaaagtaacgatgtacaagttggtaatcaaactactcccgtaccccccggtaaccgaccccccaaaactccctacattctaataaggaatacgcccaggccggccctcgacgggggtcccctggccccctattctcgtcggcctacggaacgtcgtcggccctaccctcacgcccctcccgttggcctgcgaggtcggctcgagtcgtggaggatgaggctgtaacttatttagttgtcgngagcggtaggatggtaccgttntggngttggcgttgggtcggttcgttcggggcgggttaacgggaccaggtcgtccggaacccgttccggtcggggacctcggccccgtaacggg

SEQ ID NO: 388473 - DNA, 772 bp, Homo sapiens
  misc_feature: GZ8MTXP01BJOOA.11.67.G01.1.454.CMB.2.raw
  modified_base (189)..(189): a, c, t, g, unknown or other
  modified_base (211)..(211): a, c, t, g, unknown or other
  modified_base (215)..(215): a, c, t, g, unknown or other
  modified_base (226)..(226): a, c, t, g, unknown or other
  modified_base (233)..(233): a, c, t, g, unknown or other
  modified_base (236)..(236): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctnagcgtcgtcggggacccccggnaganactcacatctnttgtacngancagctacaatagtacggaagtacgatagtactaagttgtactacaactaccgtcccgtacccccggtacccgaccccctaaacctcctactacttactaagtaacgtaactacgaccgacggccgacccgtacggaccggggtcccgtacggtccccgtacttcgtcgtcggaccgttaacgtaacgtcgtacggaccctacccgtccgacccgtccccttcccgtccggtcccgtcggacggtacgggtccgggtacccttaccgtacggttcgtagggaacgggtacgtagggtacggtacttacggttaacgtttagtttacggttcgtacgggtaccggtaggggtcgggtaggggtaacgtcgggttaccgggtagttcgggtcggttggtcgggtttcggggttcggggttccgggtaccgggggtaccggggttaacggggttacccggttacgggtcccgggttaccgggtaaccccgggttccgggtacggggttacccgtaacccgggttaaccccggtaacgggg

SEQ ID NO: 388474 - DNA, 589 bp, Homo sapiens
  misc_feature: GZ8MTXP01E1DC5.11.67.G01.1.454.CMB.2.raw
  modified_base (210)..(210): a, c, t, g, unknown or other
  modified_base (238)..(238): a, c, t, g, unknown or other
  modified_base (487)..(487): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtctgggaccccccgggnagagaatcaccatctcttgtactggaancagcctaccaatagtacggaagtaacgatgtacaattggtatacaacactccgtcccccggtaccgacccccaaacctcctcatctataagaatacgcccacgccggccctcgacgggggtcccgtcggccccgtacttctcgtcggcgtacgacgtcgtcgccacctcacgccctcccgtcggcctgcgaggtcgggcctccgacgtcgtggagggagtggacggctgtacgttatttattgtcgcgnggcggtgggagtggtcggtcgtggtgtcgtcgttggtcgggttcggttcggggcgggacgggaccgagcgtcggcccgtccgtcgggctaacgcccgaacgg

SEQ ID NO: 388475 - DNA, 628 bp, Homo sapiens
  misc_feature: GZ8MTXP01B9AIH.11.67.G01.1.454.CMB.2.raw
  modified_base (618)..(618): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtccagtgtgaggtggagttattgcagtcgtggggggggcttgggtgcgaggccggagggggtccctgagactctcctgtgtagctctggattctagttagcagctaacgccatcgaccgtggcccgcgaggctccgaggggaagggcgtggaggttgggtctcggacttagttaaagtcggaccccgacgggtggacgtaaagacctaaagtaaccgtaacgaccgaggacggttccgtagccggaacggggcccgaagttcgaccaacctactcccttacccaaagaacgaacctaaacgttccccgaaagtaacgaaccgtctacggggtaaccctagaccaaagttcggaacacgccgtagacgcggaccgacgccgaacggtcgttatacgttactgtgacccagaactccggctaagtatacgttcncgaacgtggg

SEQ ID NO: 388476 - DNA, 627 bp, Homo sapiens
  misc_feature: GZ8MTXP01DGSCE.11.67.G01.1.454.CMB.2.raw
  modified_base (531)..(531): a, c, t, g, unknown or other
tcagcgagagataccacgaccggtgctcgatttagagtatacatattggggggggcttggtgcagccgagggggtccctgagactctcctgtgtaggctctggattcagttttagcagctacgccatgacctgggtccgccaggctccgagggaaggggctggagtgggtctcggctattaatggccacggtggcaagacatactacgcagagtccgtgcagggccatgcaccatctccagagacaattcccagaagacgctgtacctgacaaatggacagcctgagacgccgacgacacggccgtatattactgtacgccaagaaactccgtacagaacttattcgaccctacgtggtcgcaaacgttgaccttaacggacctcccttaacttaattacgaccaacccatatacggaaccgtcggtggggaaccaaaaggggacccacgggttacaacgttcgtcctacctccgacgtccctacccgaaaccgaaccggggaccccagttccccggtccctttcccccgnggccctaaccccttccctaccaaacgcgacacccgtcggcgggaccacgacggcccgccgtgggcctcgcccgtggacctaacggttccttaaccg

SEQ ID NO: 388477 - DNA, 567 bp, Homo sapiens
  misc_feature: GZ8MTXP01BLMZ2.11.67.G01.1.454.CMB.2.raw
  modified_base (208)..(208): a, c, t, g, unknown or other
  modified_base (346)..(346): a, c, t, g, unknown or other
  modified_base (419)..(419): a, c, t, g, unknown or other
  modified_base (470)..(470): a, c, t, g, unknown or other
  modified_base (474)..(474): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctaccaatatcggaagtaacgatgtcaattggtatcaacatcctcccccggtacgcccccaaactcctcatctataggaatagccagccgccctcgacggggtcccnggcccctattctcgtcgctcgaagtctggccactcacgccctccgtgccctgcagtcggctcgagtctgacgntgaggctagacttatttagtcgtagccgaggtcgtgggactggtaccggtntggngtcgtcgttagggttggttccgttacggggcggttaacggggccaaggtccgtacgaacccggttcgtgggttaccaacggccccgtaacggg

SEQ ID NO: 388478 - DNA, 685 bp, Homo sapiens
  misc_feature: GZ8MTXP01CTGVW.11.67.G01.1.454.CMB.2.raw
  modified_base (207)..(207): a, c, t, g, unknown or other
  modified_base (211)..(211): a, c, t, g, unknown or other
  modified_base (235)..(235): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccacctcagcgtctcgggacccccggnaganactcactatctctgtactggaacncagctacaatacgtacggaagtaacgatgtacaagttggtactacaactactcccgtaccccggtaaccgaccccctaaactcctactactactaagtaacggaactacgacccgacggcccggtacccgtacggaccgggggttccctcggtccccgttactttcgtcgtacggtccgtaacggtaacgttccgtacggacctaccctcgaccgtccccttccgtcggtcctcgcgtacggtcggcctaccgtagttcgtaggacggtagtggacggtacgttacgtaacgtttagtttacgttggtacgacgtaggtcggttaggtacgttcggtaccggtgttaggtggttcggtcggttgggttcggttcggttacggggacgggacgggttaccgaaggtccgtacggtccggttcggtcgggttacctaaccggcccgtaacgg

SEQ ID NO: 388479 - DNA, 703 bp, Homo sapiens
  misc_feature: GZ8MTXP01D1WNQ.11.67.G01.1.454.CMB.2.raw
  modified_base (176)..(176): a, c, t, g, unknown or other
  modified_base (197)..(197): a, c, t, g, unknown or other
  modified_base (201)..(201): a, c, t, g, unknown or other
  modified_base (217)..(217): a, c, t, g, unknown or other
  modified_base (221)..(221): a, c, t, g, unknown or other
  modified_base (224)..(224): a, c, t, g, unknown or other
  modified_base (244)..(244): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctnagcgtctcggggacccccggnaganatcacatctcttgacnggancanctacaatagacggaagtacntgtactaagttgtatacaactactcccgtaccccggtaccgacccctaactcctactactactaagtaaggaactacgaccgacggcccggtaccccgtacggtaccgggggttcccgtcgggtaccgtacgtttccgttcgtacggtccgtacggtaaccgttccgtacggaccctacccgtaccgtaacccgtccccgttcccgtcgggtacccgtcggccgtagggtccgggtcctaccgtacgttcgtaggacggtagtaggtacgtacgttagtacttagttagttgtgtacgtacggtcggggtaggtagtcggtacggtcgtggtggtcgtcgttggttcggttccggtcggggacgggaacggtacgacggtccgttacggtccggttcggttcgggttccgacggtccgtacggtcccgtcccggtccccgttcggtccgttccgttccg

SEQ ID NO: 388480 - DNA, 679 bp, Homo sapiens
  misc_feature: GZ8MTXP01DDMBP.11.67.G01.1.454.CMB.2.raw
  modified_base (175)..(175): a, c, t, g, unknown or other
  modified_base (197)..(197): a, c, t, g, unknown or other
  modified_base (226)..(226): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccacctnagcgtcgtcggggacccccggnagagaactcaccatctcttgtactggaancagctacaatatacggaaataacgatgtactaaagttggtatcaaacactcccgtacccccggtaacggaccccccaaaactcctacatctataggaatacgccagccggccctcgacgggggtccctgggccgtattctcgtggctcgaacgtcgtggcctacctcaacgccctccgtggcctgcgaggtcgggctccgagtcgtggacgtgtggaggtctaggtacttagttagtgtacgacgtaggtcggggtaggggtagttcggtaccgggtgtggtagtcggtcgttcgggttcgggttccggttcgggggacgggttaacgggacccgttaaagggtccgttaccggtacccgggttccggttacggggccaacccgggaaccccggtaaccggtcccgttccccggtccccccggttcgggttaacccttcccgttttcccccgg

SEQ ID NO: 388481 - DNA, 576 bp, Homo sapiens
  misc_feature: GZ8MTXP01D558Q.11.67.G01.1.454.CMB.2.raw
  modified_base (564)..(564): a, c, t, g, unknown or other
  modified_base (567)..(567): a, c, t, g, unknown or other
  modified_base (571)..(571): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttattttaaaaggtgtccagtgtgaggtggagttattgcagtcgtgggggggcttggtgcagccggaggggtcctgagctctctgtgtaggctctggtattctagttagcagctacgccatcgaccgtggtcccgcgaggctaccggagggaagggctgggaggtgggtcgtcggtctataaagtcggcccgacggtgacgaagacaaatactaagcagacgtccgtgcgacggggcatcgacaacgatacgtccaaagtacgaaactacctacccgaagaaacgaccgtctacggggttaaccctggaaaccaaagtccggaactacgccgtagacgacgtaccgacgaacgaacggcttattacttacgtgtacacgaagactcgacaanatncgcncgtgg

SEQ ID NO: 388482 - DNA, 575 bp, Homo sapiens
  misc_feature: GZ8MTXP01BHI8J.11.67.G01.1.454.CMB.2.raw
  modified_base (397)..(397): a, c, t, g, unknown or other
  modified_base (408)..(408): a, c, t, g, unknown or other
tcagcgagagataccacgaccggtgctcgatttagagtatacatattggggggggcttggtgcagccgagggggtccctgagactctcctgtgtaggctctggattcagttttagcagctacgccatgacctgggtccgccaggctccagggaagggctggagtgggtctcggctattaatggccacggtggcaagacatactacgcagagtccgtgcagggccgatcgcaccatctccagagacaattcccagaagacgctgtacctgacaaatggacagcctgagacgccgagacacggacctatatactgtcgaccaagaaactccgtacaagtactagtcgcctacgtggtacgacaacgtcgactaacgactaccctactattacacaccanatggacgtcgnggggacaaacgggaccacggtacactcgtcctctacacgacctccgaccgaaccggccctacgtcccgtcccttccccgtcgccctaccctccctaccacgaacgcaccgtcgcggggccacgcgccggcccgtggcgtcgccgtcgttacgaacggttcttaaccg

SEQ ID NO: 388483 - DNA, 639 bp, Homo sapiens
  misc_feature: GZ8MTXP01DJLN3.11.67.G01.1.454.CMB.2.raw
tcagcgagagataccacgaccggtgctcgatttagagtatacatattgggtttgggggggttgagaagacaggactcaggacaatctccaacatggcctggtctcctctcctcctcactctcctcgctcactgcacagggtcctgggcccagtctgcgctgacgcagccgccctcagtgtctggggccccagggcagagggtcgccatctctgcactgggtccacctccaatagtcggggccggttatggtatgctctggtatcaacaacgtccaaggaatcggacccccaaactccctacatctaatgctgaacaaacaactcgacctttcgacggggtccctgtaccgttctcgtcggccctccaagtctcggtccttccgttcccgtcccttccttcggccctatccacgtcgggccgttcgaggtctacgacgtatggaggtctagtactttactactgtctgttcctagtcgaacctacgacctacgacgtaccgttcccgggtttcgggacgggtaagggtactaaggccttacggttacccgttaccgttaaggttccacggttacccgaacggttcctcccggacccccgttcggttcctaccttccgtaacccgtttcccccgtaacccc

SEQ ID NO: 388484 - DNA, 776 bp, Homo sapiens
  misc_feature: GZ8MTXP01AXM13.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcagtcggtggggggggcttggtgcagccggagggggtcctgagactctctgtgtaggctcgtggattctagttagcagctacgccatcgaccgtggtcccgcgaggctccgaagggggaaggggcgtgggagtgggtctcggtactaagttaacgtcgggacccccgtacggggtggaactaaaacggactaaacttaaaccgtaaccggactaaacgggaacggttccccggtaggaccggaacggggggcccctaaagttccggaacctaacccgaaacttcccgtaacccgaaaggtaaccggaaacctaaaccttacccccgaaaaggtaaaaccgaccggtacccgttaacgggggttaaccccttagggaaaccctaaaaagttacggggaacccaacggtacccgtaagggaaccggtaaccggaccccggaaacgtaacccggaaccggtacccgttaaattaacgttaccgtacggtaacaaccccgttaaagaaaacccgtttccccggtaaaccaacggttaactagtttacggaacccgttaacggttcgggg

SEQ ID NO: 388485 - DNA, 829 bp, Homo sapiens
  misc_feature: GZ8MTXP01EUGO7.11.67.G01.1.454.CMB.2.raw
  modified_base (198)..(198): a, c, t, g, unknown or other
  modified_base (221)..(221): a, c, t, g, unknown or other
  modified_base (226)..(226): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctcagcgtctcggggaccccccggnagagactcacattctcttgtacnggaancagcctacaatacgtacgggaaagtaacgattgtactaaagttggtactacaactactcccgtacccccggtaacccgaccccctaaactccctactaactactaagtaaggaaactacgccgacggtccggccccgtacggtaccgggggtccctcgggtccgtattccgtcgtcggtccgtacggtaacgttcgtacggaccctacccgtccgtaacccgtcccgttcccggtcggtcccgtcggtaccggtacggggttcggggtcccttaccggtacgttacgtagggtaacgggtacgtagggacgggtacgttacgttaacgtttagtttacgttacggtacggtacgtacggggtcgggggttaggggtacggttacgggtacgggttcggtcgggtaggttcgggtccgggtttacgggttcgggggttcccgggttaccgggggaccgggggtaaacggggtaaccgttacgggtaccggttaccgggtaccccgggttacgggttacggggttacccgaccgggtaacccgggtaccgggtcccgttaccccgggtcccccggttaccggttaacccttaacccggtttcccg

SEQ ID NO: 388486 - DNA, 704 bp, Homo sapiens
  misc_feature: GZ8MTXP01CFRNT.11.67.G01.1.454.CMB.2.raw
  modified_base (209)..(209): a, c, t, g, unknown or other
  modified_base (213)..(213): a, c, t, g, unknown or other
  modified_base (236)..(236): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcggggacccccggnaganactcacatctcttgtactggaancagctacaatagtacggaagtaacgatgtactaagttgtatacaactactcccgtaccccggtaccgacccctaaactcctacactactaagtaaggaactacgaccgacggccggtcccgtcggacggggtccctcggaccccgtacttcgtcgtcggtcctaacgtacgtcgtcggaccctacccgtcgaccgtccctcccgtcggtccgtcgcggtacgggtcgggtcctaccgtacggttcgtagggacggtagtcggacggtacgttaggttaacgtttaagtttagttcgtacggtacgtacgggtcggttaggggtacgtcgggtaccgggttcgtagggtggttcggtcggttacgggttcgggttaccggttccggggacggggttaaccgggaccgttacgggtccgtacggtaacccggttcggtcgggttaccgaaccgggttaacccggtaacgg

SEQ ID NO: 388487 - DNA, 633 bp, Homo sapiens
  misc_feature: GZ8MTXP01DYN0F.11.67.G01.1.454.CMB.2.raw
  modified_base (196)..(196): a, c, t, g, unknown or other
  modified_base (224)..(224): a, c, t, g, unknown or other
  modified_base (306)..(306): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtcgtcgggacccccggnagagaatcaccatctcttgtactggaancagctacaatagtacggaataacgatgtactaaattggtatcaaacatcctccccggtacgacccccaaactcctcatctanaggaatacgccagccgccctcgacgggggtcccctcgggccgtatttccgtcgtggctacggaacgtccgtcggcctaccctcaaccgtccctcccgtggccctgcgaggtcgggcctcagttcgtggaggtagtgagcgttacgtacttagttagttgtgacgtaggcggggtagggtgttaggtacggttgtaggtggtgtcgttggttcgggtccgttcgggcgggaacgggtaacgaaggtccgttcggtacccgtcggttcgggttccaccgggaacccgaacggccgtcccgtccccgttccggtccttaaccgtttcccg

SEQ ID NO: 388488 - DNA, 602 bp, Homo sapiens
  misc_feature: GZ8MTXP01B10LW.11.67.G01.1.454.CMB.2.raw
  modified_base (198)..(198): a, c, t, g, unknown or other
  modified_base (275)..(275): a, c, t, g, unknown or other
  modified_base (431)..(431): a, c, t, g, unknown or other
  modified_base (486)..(486): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtcgtcggggacccccgggnagagaatcaccatctcttgtactggaagcagctaccaatatcggaagtaacgatgtacaaattggtatcaacatccnccccggtacggcccccaaactcctcatctataggaatagccagccgccctcgacgggggtcccctgggccgtatttcctcgtcggctcggaacgtctgggccaccctcaacgccctcccgtggccctgccaggtcggggcctccagtctggacggntggaggtctagtacttattagttgtgcaggcggggtgggagtggacgggtctggngtgtcgttggtggttcgttcgggcgggtaagggaccgaggtccgttcggtacccggtccgttcggggttcgacggcccgacggtcctccggcccccgttcggtccttccgttcccg

SEQ ID NO: 388489 - DNA, 583 bp, Homo sapiens
  misc_feature: GZ8MTXP01B80UL.11.67.G01.1.454.CMB.2.raw
  modified_base (439)..(439): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcagtcgtggggggggcttgggtgcaggccggagggggtccctgagactctcctgtgtaggctctggtattctagtttagcagctacgccatcgaccgtgggtcccgccgaggcgtcccgaagggggaaggggcgtgggaggttgggtcgtcggcttaagttaagtcggaccccacggggtgacaagacaatactcgcagacgtccgtgcgacgggccatcgcacatcnccagacgaacaacttcccaagaacgacgctacggtactgacaaagtcgaacgcgctaggagcgaccgacgacgcgaccgttatacgttcgtgtcgaccgttaagaacttccgacctaagacttagttcgccgttaacgttcggg

SEQ ID NO: 388490 - DNA, 659 bp, Homo sapiens
  misc_feature: GZ8MTXP01C27Q5.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttattttaaaaggtgtccagtgtgaggtggagttatgcaggtcggtggggggggcttgggtgcgagccggagggggtccctgagactctcctgtgtaggctcgtggtattctagtttagcagctacgccagtcgaccgtcgggtcccgccgacggcctcccggagggggaaggggcgtgggaggttcgggtcgtcggtacttaagttaagtcggaccccgacgggtagcgaaagacaaagtactaacggcaaggtacggtccgtgacgacggggccgatcgaccaccactacctaccgaagaacgactaacgttaccccaagaaacgaccgtaccttacgggtaaccctgaaccaaagtcggaaccacgcctagggacgacggacccgaacgaccgaaccggtccttaaattacgttacgtagtaccgaaccgttaacgttaaaacgtcccgtaacgaagtaacttagttcgaacttcggttaaggg

SEQ ID NO: 388491 - DNA, 688 bp, Homo sapiens
  misc_feature: GZ8MTXP01DA3F0.11.67.G01.1.454.CMB.2.raw
  modified_base (173)..(173): a, c, t, g, unknown or other
  modified_base (216)..(216): a, c, t, g, unknown or other
  modified_base (220)..(220): a, c, t, g, unknown or other
  modified_base (230)..(230): a, c, t, g, unknown or other
  modified_base (249)..(249): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttcngacctcacgccaccctcaggccgtcgtcggggaccccccgganaganaactccactntctcttagtacgaggaacncacgcctacaagtagtacggaaagtaacgatgtactaagttagtactacaactacctccccgtaccccggtaccgaccccctaaactcctactactactaagtaacgaactacgaccgacggcccggtacccgtacggtaccggggtcccgtcggtacccccgtagttcgtcgtcggtaccgtaacgtaacgtccgtacgaccctacccgtaccgaccgtccccgtccgcggtccctcgcgtacgggtcgtcctcgagtcgtaggacggtagtaggacgtacttagtacgtttagttagtgtcgacgtggtcggtaggtacgtcggtacggttgtaggtggttcgtcggttgggttcgggttccgggttacggggacgggacggaccgttacggtccgtacggtcccggttcggcggttaccgtaaccggcccgtaacg

SEQ ID NO: 388492 - DNA, 851 bp, Homo sapiens
  misc_feature: GZ8MTXP01B5WHC.11.67.G01.1.454.CMB.2.raw
  modified_base (200)..(200): a, c, t, g, unknown or other
  modified_base (204)..(204): a, c, t, g, unknown or other
  modified_base (211)..(211): a, c, t, g, unknown or other
  modified_base (215)..(215): a, c, t, g, unknown or other
  modified_base (220)..(220): a, c, t, g, unknown or other
  modified_base (224)..(224): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaaccctcagcgtcgtcggggacccccgganaganactcacntctntgtanggancagctacaatagtacggaagtaacgatgtactaagttgtatacaactactcccgtaccccggtacccgacccctaactcctactatactaagtaggaatacgaccgacggcccggtcccgtacggtaccggggtcccgtcggtaccgtacgtttccgtcgtcggtacgtacgtaaccgtccgtacgaccctacccgtccgtaacccgtccccttcccggtcgggtcccgtacggtaccggtacggggtccgggtacctacccgtacgttcgtagggtaacgggtacgtacgggtacgggtacgttaacgttaacgtttaagtttagttcggttacggtacggtacgggttcggggggttacggggtagggttacgggttacgggttcggttagggttacggttcgggttcgggtttcggggtttccgggggtttaccggggttaccgggggtaaccgggggtaaacccgggggtaaacccggttaacggggtacccggttacccggggttaccccgggttccggggttaccggggttacccggacccggggtaaccccgggtacccgggttcccggtacccccgggtcccccggttaccggttaaccccgttaacccgtttccccgg

SEQ ID NO: 388493 - DNA, 865 bp, Homo sapiens
  misc_feature: GZ8MTXP01BP674.11.67.G01.1.454.CMB.2.raw
  modified_base (177)..(177): a, c, t, g, unknown or other
  modified_base (199)..(199): a, c, t, g, unknown or other
  modified_base (222)..(222): a, c, t, g, unknown or other
  modified_base (227)..(227): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcacgccaccctnagcgtcgtcggggacccccggnagagaatcaccatctcttgtacnggaancagctacaatatacgggaaataacgatgtactaagttggtatacaacactcccgtacccccgggtaacccggacccccctaaaactccctacaacttacctaaagtaaggaaactacggacccaacggtccccggtccccgtacggaccggggggttccccctacggggtaccccgttacgtttccgttccgtcggggtacccttaccgggtaaacggttcccggttacggggacccctaaccccgttcccggaaacccggttcccccttcccccgggtcggggtcccccgttgggacccgtacggggttccgggggcccttaccccgggtaaggttcccggttaggggaaacggggtaggttacgggaacggggtaccgttacgggttaaacttttaagtttacgttgggtacggtaccggtacggggtcgggggttagggggtaacgttcggggtaaccgggttcgttagggtcggttcggtcggtttggggttccgggttccggtttaccgggggcggggtaacggggaacccgttaagggtccgttcggtaacccgggttcggttacggggttccgaccggtaacccgaacggtccgtccccggtccccggttcggtaacccttcgtttccccg

SEQ ID NO: 388494 - DNA, 733 bp, Homo sapiens
  misc_feature: GZ8MTXP01EXJFY.11.67.G01.1.454.CMB.2.raw
  modified_base (177)..(177): a, c, t, g, unknown or other
  modified_base (196)..(196): a, c, t, g, unknown or other
  modified_base (200)..(200): a, c, t, g, unknown or other
  modified_base (206)..(206): a, c, t, g, unknown or other
  modified_base (210)..(210): a, c, t, g, unknown or other
  modified_base (215)..(215): a, c, t, g, unknown or other
  modified_base (218)..(218): a, c, t, g, unknown or other
  modified_base (221)..(221): a, c, t, g, unknown or other
  modified_base (239)..(239): a, c, t, g, unknown or other
  modified_base (250)..(250): a, c, t, g, unknown or other
  modified_base (255)..(255): a, c, t, g, unknown or other
  modified_base (301)..(301): a, c, t, g, unknown or other
tcagcgagagataccacgaccggtgctcgatttagagtatacatattggggtttggggggggttgagaagacaggactcaggacaatctccagcatggccagcttccctctcctcctcaccctcctcactcactgtgcagggtcctgggcccagtctgttctgactcagccaccctnagcgtctcgggaccccggnaganatcacntctntgacngancanctacaatagacgaatacntgtatatgtanacacnctccgaccccggtaccgaccctaactcctacactactaagtagaanacgacgacgccgccgtacggtacgggtcctcggtcgtacttcgtcgtcgctacgtacgtcgtcgacctccgtacgtaaccgtcccgtcccgtcggtccgtcgccgtagggttccgggtctaccgtacgttcgtaggtaaggtacgtaggacggtcgttaacgttaactttagtttaggttcgtacggtacgtacgggttcgggggtaggggtacgttcgggtaccgggttgtacggtacggttcggttaccggttcgggttcgggttaccggggtaccggggaacggggtaaccgggtaaccgttacgggtcccggttaccggtacccgggtttccggttacggggttcccgaacccggggtccccgtaaccgggtccccggttaccccggtccccgggtttaccgttaaccccgtttaacccgtttccccg

SEQ ID NO: 388495 - DNA, 831 bp, Homo sapiens
  misc_feature: GZ8MTXP01AHVJB.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtctttttcttgtggtcttaattttaaaaggtgtccagtgtgaggtggagttattgcaggtcggtggggggggcttgggtgcgaggccggagggggtccctgagactctcctggtgtaggctcgtggtattcgtagtttagcagctacgccatcggaccgtcgggtcccgccgaggcctaccgggaagggggaacgggggtccgtgggggtacggttcgggggttccgtacggggtactttaaagtttaaacggtcggggtacccccccgtaacgggggtcgggaaccaaaacggtaaccctaaaacgttaacccgttaaccggcgtaaaccgggtaacggttccccgggtggaccggaacgggggaccccgtaagttccggaccccaaaccgtactccccgttaaccgaaacgggaacgtaaacctaaaccgttacccccgaaaggaaaccgggtaccgtaccgttacggggttaacccgtaggaaacccgtaaaaaggttccgggaaaccacggtaccccgttagggaaccgtacccgggaaccccggtaaccggaacccgggtaaccggtacccgttaaagttaaccttaaccgttggtaacccgaccgttaaacgaaaccgttccccggtacaacggtaattacgttccggtaacgttccggttaagggg

SEQ ID NO: 388496 - DNA, 573 bp, Homo sapiens
  misc_feature: GZ8MTXP01CAU70.11.67.G01.1.454.CMB.2.raw
  modified_base (175)..(175): a, c, t, g, unknown or other
  modified_base (195)..(195): a, c, t, g, unknown or other
  modified_base (223)..(223): a, c, t, g, unknown or other
  modified_base (233)..(233): a, c, t, g, unknown or other
  modified_base (244)..(244): a, c, t, g, unknown or other
  modified_base (266)..(266): a, c, t, g, unknown or other
  modified_base (329)..(329): a, c, t, g, unknown or other
  modified_base (364)..(364): a, c, t, g, unknown or other
  modified_base (428)..(428): a, c, t, g, unknown or other
  modified_base (461)..(461): a, c, t, g, unknown or other
  modified_base (543)..(543): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctnagcgtctcgggacccccggnagagaatcaccatctcttgtactggaancagctcaatntcggaatacgntgtacaattggtatcaacatcnccccggtacggcccccaaactcctcatctataggaatagccagccgccctcgacggggtcccngggccgattctcgtggctcgaacgtctggccaccncacgccctcctggccctgcgagtcgggctccgagtctggagagtgaggctgacttattagtgtncgaggtcggggtgggatcgggacgttcgtaggngtgcgttggtcggttacgttcggggcggtaacgggaccaggtccgttacgcccggtcgttgggttccacgtcccgaggtccncccggccccgttcggtccttaacgttcccg

SEQ ID NO: 388497 - DNA, 697 bp, Homo sapiens
  misc_feature: GZ8MTXP01A68VF.11.67.G01.1.454.CMB.2.raw
  modified_base (175)..(175): a, c, t, g, unknown or other
  modified_base (197)..(197): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctnagcgtcgtcggggacccccggnagagaatcaccatctcttgtactggaagcagcctaccaatagtacggaaagtaacgatgtacaaattggtatcaacatccgtcccccggtacggaccccccaaactcctacatctataggaatacgccagccgccctcgacggggtccctggccgtattcgtcgtggctcgaacgtctggccacctcaacgccctccgtggcctgctacggtcgggccttcgagttcaggagagtggacggtctacgtacttagttagtgtcgacgtaggtcgggggttaggggtacgttcgggtaaccgggttgtgggtacgttggttccggttgggttaaccggggtttccggtttaccgggggcggggaacggggtaaacccgaaggggttcccgttaccggggttaaccccggttccgggttacggggttcccgaaccggtaaccccggtaacgggtccccgttccccgggaccccgtttccgggtcccttaacccgttttccccg

SEQ ID NO: 388498 - DNA, 715 bp, Homo sapiens
  misc_feature: GZ8MTXP01A6JHR.11.67.G01.1.454.CMB.2.raw
  modified_base (188)..(188): a, c, t, g, unknown or other
  modified_base (210)..(210): a, c, t, g, unknown or other
  modified_base (214)..(214): a, c, t, g, unknown or other
  modified_base (222)..(222): a, c, t, g, unknown or other
  modified_base (233)..(233): a, c, t, g, unknown or other
  modified_base (236)..(236): a, c, t, g, unknown or other
  modified_base (260)..(260): a, c, t, g, unknown or other
  modified_base (263)..(263): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctnagcgtcgtcggggacccccggnaganactcactntctctagtacngancagtctacaatagacggaagtacngtntataagttgtactacaactctcccgtaccccggtaccacccctaactcctactatacgtaagtagaactacgacccgacgcccggtcccgtacgggtacggggtccctcggtaccccctacgttccgtcgtcggtaccgttaaacggacgttccgtacggacccctacccgtccgtaccgtccccgttccgtacggtccgtcgtccggtagggtccggtcctacggtacgtcgtacgggaggtacgtcgggaccggttactacgttaacgtttagtttaggttcggacgacgtacggtacgggtacggtacggtacggtacggtacggttacggtcggtcggttcggttcgggttcgggttcgggttacggggtacggggaccgggttaccggacggtcggtaccggtcccggtccgggtaccgggttaccggtaaccggcccggtaaccgg

SEQ ID NO: 388499 - DNA, 622 bp, Homo sapiens
  misc_feature: GZ8MTXP01CF8LD.11.67.G01.1.454.CMB.2.raw
  modified_base (195)..(195): a, c, t, g, unknown or other
  modified_base (434)..(434): a, c, t, g, unknown or other
  modified_base (491)..(491): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtcgtggggacccccggnagagaatcaccatctcttgtactggaagcagcctaccaatatcggaagtaacgatgtacaaagttggtatcaacatccgtcccccggtacggccccccaaactcctcacttctaataggaatacgccaggccggcccctcgacgggggtcccctgggcccgatttccgtctggcttcggaacgtctggccaccctcaaccgccctcccgtggcctgcaggtcggctcgagtcgtgaggngtgaggtctgacttagttagttgtgcgtaggcggggtagggtagtcggtaccgggtnttgggagttgtcgttggtcgggttcgttcggggcgggtaacgggaaccgttaggccgttcgtacccggtcgttcgggttcgacggtcccgacgggtccgtcccggccccgttccggtccgttcgttcccgg

SEQ ID NO: 388500 - DNA, 653 bp, Homo sapiens
  misc_feature: GZ8MTXP01ERBFP.11.67.G01.1.454.CMB.2.raw
  modified_base (189)..(189): a, c, t, g, unknown or other
  modified_base (209)..(209): a, c, t, g, unknown or other
  modified_base (224)..(224): a, c, t, g, unknown or other
  modified_base (236)..(236): a, c, t, g, unknown or other
  modified_base (262)..(262): a, c, t, g, unknown or other
  modified_base (488)..(488): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctnagcgtcgtcgggaccccggnagagaatcacatctnttgtactggaancagctaccaatagtcggaagtaacgntgtcaagttggtatcaactactccgtcccccggtacgacccccaaactccctacatctatagaatacgccaggccggccctcgacggggtccctggcccctattctcgtggctacgaagttcgtggaccacctcgacgtccctcccgtgggcctgacagggtcgggcctccgtaaggttcctaggacggattggacgtctagtaactttagtttaacgttgtacgngtacggtcggtagggagttcggaccggttctgggtacggtggtcgtttacgggggttgggttccggttaccgggggcggggaacgggggttacccttaaagggtcccgttcggtaacccccgggtccgggtttggggaccccgtaacggccccgggtaaccgggg

SEQ ID NO: 388501 - DNA, 745 bp, Homo sapiens
  misc_feature: GZ8MTXP01C54V5.11.67.G01.1.454.CMB.2.raw
  modified_base (176)..(176): a, c, t, g, unknown or other
  modified_base (198)..(198): a, c, t, g, unknown or other
  modified_base (251)..(251): a, c, t, g, unknown or other
  modified_base (385)..(385): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctnagcgtcgtcggggacccccggnagagaatcaccatctcttgtactggaagcagctaccaatatcggaagtaacgntgtactaattgtatcaacactccgtaccccggtaccggacccccaaactccctacactctaagtaggaaatacgccaaggccggccctcgacgggggtccctgggccgtattctcgtggctcgaacgtctggcncctcgaaccgtccctcccgtggcctggcaggtcgggctccgagtctggaggatggaggctaggaactttagttagttggtcgtcgacgggtcgggggttagggggtacgttcgggtaacgggttcgtcgggtaggttcgggttccgtttcgggggtttcggggtttcccggttaccggggggccggggtaaacgggggtaacccgttaaaggggttcccgttacggggttaaccccggttccgggttacgggggttacccgttaacccggggtaaccccggtaaacccggggtcccggtttaccccgggtcccccccggttccggggtttaaccccgttaaccccggtttttcccccggg

SEQ ID NO: 388502 - DNA, 727 bp, Homo sapiens
  misc_feature: GZ8MTXP01AEQ35.11.67.G01.1.454.CMB.2.raw
  modified_base (197)..(197): a, c, t, g, unknown or other
  modified_base (201)..(201): a, c, t, g, unknown or other
  modified_base (208)..(208): a, c, t, g, unknown or other
  modified_base (212)..(212): a, c, t, g, unknown or other
  modified_base (217)..(217): a, c, t, g, unknown or other
  modified_base (220)..(220): a, c, t, g, unknown or other
  modified_base (245)..(245): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctcagcgtcgtcgggacccccggnaganactcacntctntgacngancagctacaatgtacggaaagtacgntgtactaagttgtactacaactactcccgtaccccggtaccgacccctaactcctactactactaagtaaggaactacgaccgacggcccggtcccgtacggtaccggggtcccgtcggtccgtacttccgtcgtcggtacgtacggtaccgtcgtcgaccctaccctcgacccgtcccgtccgtcgtccgtacgcgtcgggtcggtcctacgtacgtcgtaggaggtagtacggtacggtacgtacgttaacgtttagtttacgttcgtacggtacggtagggtcgggggtaggggtaggttcgggttacgggttcggtggtaggttcggtcggttcgggttccgggttacgggtccgggggacggggtaacgggaccgttacggtccggttaccggtacccggttcggttcgggccgttacccgggaacccggtacggtcccgttcccggtccccggttacgtcccgttaaccgttcccg

SEQ ID NO: 388503 - DNA, 603 bp, Homo sapiens
  misc_feature: GZ8MTXP01CVQ14.11.67.G01.1.454.CMB.2.raw
  modified_base (320)..(320): a, c, t, g, unknown or other
  modified_base (404)..(404): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgctaggtcggtgggggggggtcttgggtgcaggccggagggggtccctgacgactctcctgtgtaggctctggattctagtttagcagctacgccatcgactgggtcccncaggcctccgagggaagggctggagtgggtctcggcttagtagtcggccccagggtgcaagacaatactaacgcagacgtccgngcgagggcccatcgaccacatcctaccagacgactaactcccgaagaacgacgtctacgggtaccctaggaaccaaaagtcggaaccacggtaccgaggacggtacgtaccgaacgacgaaccgggtacttagttacttcgtaggtcgaccaaagttaacctcccggtaccaagtatacttgtaaccgttaacgttggg

SEQ ID NO: 388504 - DNA, 681 bp, Homo sapiens
  misc_feature: GZ8MTXP01EBJ3H.11.67.G01.1.454.CMB.2.raw
  modified_base (251)..(251): a, c, t, g, unknown or other
tcagcgagagataccacgaccggtgctcgatttagagtatacatattgggggggggcttggtgcagccgaggggggtccctgagactctcctgtgtaggctctggattctagttttagcagctacgccatcgaccgtgggtccgccaggctccgaggggaaggggctggagtgggtctcggctattaatggccacggtggcaagacatactacgcagagtccgtgcgagggccatgccaccatctccaganactaacttcccaagaaacgcgtctacgtacctagacaaatcggacacgcgtgacgacgccgaacgacgacgtacgtatagttactgtcgacaagtaactccgtacaagtattagtcgaccctacgtgggtacgctaacgtcgacctaacgaccgtaccttaacttacttacaccacatacgtacggtacggtacgtacgggggactaaacggggtaccgtacggtactacgttcgtcccttcctacgaccgtacccgtacccgaaccgtaaccgggtaccctacgttcccgtccctttccccggacgtcccctaccccgtcctaccgacgtcccgtccttacccggtcgggttaccgggactaccgacgggttcccggttccggtcgggtctcggtccggtacggaccggtaaccgttccgtttaacccg

SEQ ID NO: 388505 - DNA, 732 bp, Homo sapiens
  misc_feature: GZ8MTXP01A8OHY.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttattttaaaaggtgtccagtgtgaggtggagttatgcagtcggtggggggggtcttggtgcagccggaggggtccctgagactctcctgtgtaggctctggtattcagttagcagctaacgcatcgtaccgtgggtcccgccaggcctaccggagggggaacgggcgtggaggttggtcgtccggtacttagttagtcggacccccgagggtggacaagacaacttaccgaaccgcgaggtacgtccccggtggaccggacggggcccggtaatcggaccaaccgtacttaccctcccaaacggaacgtaacctaaaccgtttaccccggaaacggaaaccggtacccggtaccgttaccggggttaacccgttacggtaaacccgaaaaggttaccgggaccgaaacggtcccggttaacggaacggtacgggtaccccggaacgggtaacccgtaaccgggtacccgttaagttacgtttaccgacggttacgacccgttaacgttaaaaccgtcccggtacctaaggaccttagttaccgcttaacgggttccggg

SEQ ID NO: 388506 - DNA, 641 bp, Homo sapiens
  misc_feature: GZ8MTXP01C0XU1.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaggtgtccagtgtgaggtggagttatgcaggtcggtggggggggtcttgggtgcgaggccggagggggtccctgagactctcctgtggtaggctctggattctagtttagcacgtctacgccatcgaccgtgggtcccgccaggctccgagggggaagggcgtagggtaggttgggtcttcgggcttaagttaagtcgggcccctacggggtgacaaagaccaaagttactaacgcaaggacgttccggtcgcgaagggcccatcgcacattccacccagacgaacaacgttcccaagaacgacgtctacgggtacctagactaagtcggacacgctaggacgacgacccgaacgtcgaaccgggtaccttaagtacttaccgtagtccgaccgaaacgttaaaccttccccgggtaactaacggttaatcggtttacgaaccgttaacggttccgggg

SEQ ID NO: 388507 - DNA, 654 bp, Homo sapiens
  misc_feature: GZ8MTXP01CBZTY.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcaggtcgtggggggggcttggtgcgaggccggagggggtccctgagactctctgtgtaggctcgtggtattctagtttagcagcctacgccatcgaccgtcgggtcccgccgaggctccgaagggggaacgggggcgtgggtaggttcggggtcgtcgggtacttagttaaacgtcggacccccgagggtcggacgaaacgactaaataccgtaacgctaacgggacgtccggtgaccgacggggcccgagtcgacccacctactcctacccgaagacgaactaactacccgaaagaacgacgcgttacggtacctacgactaaagcggaaccacgcctaggacgacgacccgaacgtaccgaacggcgttaatacgttacgtagtcgaccgttaagaaaaccgtcccgttacaaggtacttagttcgaaccgttgtaagggg

SEQ ID NO: 388508 - DNA, 690 bp, Homo sapiens
  misc_feature: GZ8MTXP01AF30V.11.67.G01.1.454.CMB.2.raw
  modified_base (194)..(194): a, c, t, g, unknown or other
  modified_base (198)..(198): a, c, t, g, unknown or other
  modified_base (221)..(221): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccggnaganactcacatctcttgtactggaancagcctacaatagtacggaaagtaacgatgtactaagttgtatacaactactcccgtaccccggtaccgacccctaaactcctactactctaagtaaggaactacgccgacggccggtcccgtcggtaccggggtccgtcgggccgtacttcgtcgttcggtcgtacggtaaccgtccgtcggaccctaccgtccgaaccgtcccctcccgtcggccgtggacgtgggtcgggtctacgtacgtcgtaggaggtagtggaggtcgtagtaacttattagttgtacgcgtaggtcgggggtagggtacgtcggtacggttcgtggtacgtcggtcggttggttcgggttccggttcggggacggggtaacggtaaccgttacggtccggttcggtaccggttccggttcgggttccgaccggaacccggacggtcccgtcccggtccccggttcgtcccgttccgtcccg

SEQ ID NO: 388509 - DNA, 785 bp, Homo sapiens
  misc_feature: GZ8MTXP01B9B6E.11.67.G01.1.454.CMB.2.raw
  modified_base (173)..(173): a, c, t, g, unknown or other
  modified_base (210)..(210): a, c, t, g, unknown or other
  modified_base (214)..(214): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttcngactcacgccaccctcagcgtcgtcggggaccccggnaganactcactatctctagtacgagacgcacgctactaatacgtacggaagtacgtatgtactaagttgtactacaactacgtacccgtaccccggtacccgacccctaaactcctactactacgtaagtagtaacgtacgaccgacggccggtaccccgtaccggtaccggggtcccgtacggtaccccgtacttcgtcgtcggtaccgtaaccggtaacgttccgtacggtaccctacccgtccgtacccgtccccgtcccggtccggtccgtcggtaccggtacgggtccggtaccgttaccgtacggttcggtaggacgggtagtacgggtacggtacgttacgttaacggttttaagtttacggtttacggtacggtacggtacgggtcgggttaggggtacggtacgggtcggttcggttacggtgggttcggtcggtttcgggggtttacggggttccggggttaaccgggggaccggggttaacggggttaaccgttaccgggtccggttaccgggtcccgggttccgggtcgggttaaccggtaaccggttaaccggtaacccggg

SEQ ID NO: 388510 - DNA, 691 bp, Homo sapiens
  misc_feature: GZ8MTXP01CXZC4.11.67.G01.1.454.CMB.2.raw
  modified_base (241)..(241): a, c, t, g, unknown or other
tcagcgagagataccacgaccggtgctcgatttagagtatacatattgggtttggggggaagaggaagactgaccggtcccccaggagttcaggtgctgggcacggtgggcatgtgtgagttttgtcacaagatttgggctcaactctcttgtccaccttggtgcagccggaggggtccctgagactctcctgtgtaggctctggattctagttttagcagctacgccatgacctggtccncaggctcgagggagggctggagtgggtctcggctaatagtggccgacggtcggacaaagactatacctacgacaggacgtccgtgcgacgggcactcgacacactcacagacgaacaactacccaagaacgctactacgtaacctcgaaacaaagtacgggaacacggaccagaacggacgaccgaaccgaacgaccggacgttacttaacttacgtcgacgacccgtaaagaaaaccgttcccgtaacgtaacggtatttaacgtacgtaccgtacggtcggttacggaaccgtaacgtccgtaaccgtaaccggtacccgtacccttaaactttacttaactaaccaacccgtaaaccgtaacgttaccgggttacggttccgggtaagggggtaaaccggtaaaccggggacccgtaacgggttccctaacgttcccgtttaacccg

SEQ ID NO: 388511 - DNA, 698 bp, Homo sapiens
  misc_feature: GZ8MTXP01CB6B2.11.67.G01.1.454.CMB.2.raw
tcagcgagagataccacgaccggtgctcgatttagagtatacatattgggtttggggggaagaggaagactgacggtccccccaggagttcaggtgctgggcacggtgggcatgtgtgagtttttgtcacaagatttgggctcaactctcttgtccaccttggtgcagccgaggggtccctgagactctcctgtgtaggctctggattctagttttagcagctacgccatgacctgggtccgccaggctccgaggggaaggggctgggagtgggtctcggctataatggccacggtgacaagacatactacgcagagtccgtgcgagggccatcgacacatcctcagacacaacttcccaagaagacgctaacgtacctgacaaagtgactagccgtagaacgacgaccgacgacgaccggaccgttagtaacgtttacgtcgtcgaacccgtaaacgaaaccgttacccgtaccccgtaaaggtaacgtttaacgttccgtaacccgtacggttacggggttaccggaccgtaaaaccgttcgtaacccgtaaccggtaacccgttacccttaaaccgttaactttaccgtaacccttaaacccgaaaccgtcgttacgggttccgggttacggtaacgggggaaaccgtaaaccgggaaccccgacgggttacctaacgttcccggtttaaccccg

SEQ ID NO: 388512 - DNA, 378 bp, Homo sapiens
  misc_feature: GZ8MTXP01BAJEG.11.67.G01.1.454.CMB.2.raw
  modified_base (238)..(238): a, c, t, g, unknown or other
  modified_base (321)..(321): a, c, t, g, unknown or other
  modified_base (368)..(378): a, c, t, g, unknown or other
tcagcgagagataccacgaccggtgctcgatttagagtatacatattgggtttggggacctatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtntgagtgctgtggtcttcggcggagggaccaagctgaccgtctgggtcagcccaaggctcgccccctggtcactctcgtccccnccctctcgtatctctcgctgacgccggctggcaaggcgtaacagtgnnnnnnnnnnn

SEQ ID NO: 388513 - DNA, 776 bp, Homo sapiens
  misc_feature: GZ8MTXP01EM1NH.11.67.G01.1.454.CMB.2.raw
  modified_base (197)..(197): a, c, t, g, unknown or other
  modified_base (209)..(209): a, c, t, g, unknown or other
  modified_base (220)..(220): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagccgtctcggggacccccggnagagactcaccntctcttgtacnggaagcagcctacaatacgtacggaaagtaacgatcgtactaagttggtactacaactactcccgtaccccggtacccgaccccctaactcctactactactaagtaaggaaactacgaccgacggcccggtaccccgtacggtaccgggggttccccgtcgggtacccgttacgtttccgttccgtcggtaccgttacggtaaccgttccgtacggacctaccctccgaacccggtccccttcccggtcgggcccgtcggaccgtacggggttccgggccttaccgtacgttcgtagggacgggtagtacgggtacggtacgttacggttaactttaagtttacgttcggtacggacgtacgggtcgggggttacggggtagttcgggtacgggttcgtgggtgttcggtacggttcgggttcgggttccggttaccgggggacggggtaacgggtaccgttacgggtccggttaccgggtaccggttcggttcggggttccaccgggcccggacggtcccgtcccggtccccgttcggtcccgttccgttcccg

SEQ ID NO: 388514 - DNA, 766 bp, Homo sapiens
  misc_feature: GZ8MTXP01DDIA6.11.67.G01.1.454.CMB.2.raw
  modified_base (177)..(177): a, c, t, g, unknown or other
  modified_base (199)..(199): a, c, t, g, unknown or other
  modified_base (211)..(211): a, c, t, g, unknown or other
  modified_base (215)..(215): a, c, t, g, unknown or other
  modified_base (221)..(221): a, c, t, g, unknown or other
  modified_base (224)..(224): a, c, t, g, unknown or other
  modified_base (227)..(227): a, c, t, g, unknown or other
  modified_base (248)..(248): a, c, t, g, unknown or other
tcagcgagagataccacgaccggtgctcgatttagagtatacatattggggtttggggggggttgagaagacaggactcaggacaatctccagcatggccagcttccctctcctcctcaccctcctcactcactgtgcagggtcctgggcccagtctgttctgactcagccaccctnagcgtctcggggacccccgganagagactcactntctntgtacngancanctacaatagtaggaagtaagntagtactaagttgtatacaactactcccgccccggtaccgaccccctaaactcctactactactaagtaggaactacgccgacggcccggtaccccgtcggtaccgggggtccctcgggtaccgtcttccgtcgtcggtactacggtaaccgttccgtacggccctacccgtcgaacccggtcccctcccggtcggtcccttgggcgtacgggtcgggtacctccgtacgtcgtaggaggtacggtaggtaggtacgtacgttaacttaagttagttagtcggacggtacgggtcgggggttacgggtacggtcgggtacgggtcgtaggtcggttcggttcggttcgggttcgggttaccggttccgggggtaacggggtaaccgggtaaccggttacggtccgggttaccgggtaccccggttccgggttaccgggttaccgacccgggtaaccccggtaacccggtccccgtccccggtcccccggttaccggttcccgttaacccggttccccg

SEQ ID NO: 388515 - DNA, 649 bp, Homo sapiens
  misc_feature: GZ8MTXP01AMCLM.11.67.G01.1.454.CMB.2.raw
  modified_base (189)..(189): a, c, t, g, unknown or other
  modified_base (210)..(210): a, c, t, g, unknown or other
  modified_base (214)..(214): a, c, t, g, unknown or other
  modified_base (578)..(578): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctnagcgtcgtcgggacccccggnaganaatcacatctcttgtactggaagcagctacaaatagtacggaagtaacgatgtacaaattggtatacaaactactcccgtacccccggtaaccgacccccaaactccctacaatctaagtaaggaaactacgcccaacggccggtcccctacggtaccgggggtccctcgggacccccctattcgtacgtggccgttaacgaacgttctcgggccctaaccctccaaccgtccccgttccccgtcggggtcccttaggccgtagggttcggggcccttaccgaggtttccgtaggaaggacgttagaggtcgtacgtaacgttatttaagttgtgtcgacgcggtggagtggtacggtcgtggngtgtcgttggtcggttcggtcgggtacgggacggacgacgtcgtcgtccgtcgtcggccgaacgccgaacg

SEQ ID NO: 388516 - DNA, 710 bp, Homo sapiens
  misc_feature: GZ8MTXP01BCANH.11.67.G01.1.454.CMB.2.raw
  modified_base (506)..(506): a, c, t, g, unknown or other
  modified_base (629)..(629): a, c, t, g, unknown or other
tcagcgagagataccacgaccggtgctcgatttagagtatacatattgggtttggggggaagaggaagactgacggtccccccaggagttcaggtgctgggcacggtgggcatgtgtgagttttgtcacaagattttgggctcaactctcttgtccaccttggtgcagccgagggggtccctgagactctcctgtgtaggctctggattcagtttttagcagctacgccatgaccgtgggtccgccaggctccgaggggaagggggctgggagtggggtctcgggcttattaagtcggccgaggtggacaaagacatacgtacgccagacgtccggtgcgacggggcccgagtcgaccacctactcctccaaggacgaacctaaaccttcccaaggaacgaccgctaactaaccgtcgaacaaaagtcgggaaccagcctagggaacgacccggacccgaaaccggttaccggaacccgggtcccgttaaattaaccgtttaacgnggttcccgaaccgtaaagtaaaccgttccccgaacacgggtaattaccgtgacctaaccgggttggacggtacctaaaccgttgacccgtaacctacccgtaccttaacttacgttaaacccncccaacgtacgtacgggttccggttacggttcgggaacggggaacgaaaccgggccgtacggttctaaccgttccgtcccg

SEQ ID NO: 388517 - DNA, 881 bp, Homo sapiens
  misc_feature: GZ8MTXP01AIFTQ.11.67.G01.1.454.CMB.2.raw
  modified_base (177)..(177): a, c, t, g, unknown or other
  modified_base (203)..(203): a, c, t, g, unknown or other
  modified_base (207)..(207): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagcccaccctnagccgtcgtcggggaccccccggganaganaactccacctattccttcgttagtacgtaggaacgcacgtcctaccaatacgtacggtaaagtaacgtattgtactaagttgtactacaactaccgtcccgtaccccggtaacccgaccccctaaactcctactaactacgtaagtaacggaactacgaccgacggtccccggtaccccgtacgggtacccgggggttccccgtacgggtacccgttacgtttccgtaccgtacgggtccgtacggtaaccgttccggtacggaccctacccgtccgtaacccggtccccgttcccggtcgggtcccgtcgggtaccgtacggggtccggtccctaccgtacggttcggtagggtaacgggtacgtcgggacggttcgttagttaacgtttagtttacgttcgggtacgtacggtacggggtacggggggttacggggtaacggttccgggtacgggttcggtacgggttacggttcggttcgggtttcggggttaccggggttaccggggttaccgggggaaccgggggtaaaccgggtaaccggttaacgggtccgggttaccgggtaccccgggttcgggttaccggggttacccgacccggtaaccccgggtacggtccccggttccccgggtcccccggttacggtaaccccgttcccggtttccccgg

SEQ ID NO: 388518 - DNA, 668 bp, Homo sapiens
  misc_feature: GZ8MTXP01C6ZHX.11.67.G01.1.454.CMB.2.raw
  modified_base (176)..(176): a, c, t, g, unknown or other
  modified_base (198)..(198): a, c, t, g, unknown or other
  modified_base (276)..(276): a, c, t, g, unknown or other
  modified_base (307)..(307): a, c, t, g, unknown or other
  modified_base (435)..(435): a, c, t, g, unknown or other
  modified_base (441)..(441): a, c, t, g, unknown or other
tcagcgagagataccacgaccggtgctcgatttagagtatacatattggggtttggggggggttgagaagacaggactcaggacaatctccagcatggccagcttccctctcctctcaccctcctcactcactgtgcagggtcctgggcccagtctgttctgactcagccaccctnagcgtcgtcggggacccccggnagagaactcaccatctcttgtactggaagcagtcctacaatagtacggaaagtaacgatgtactaaattggtatcaanactccgccccggtaccgaccccaaactcctnatctagtagaatacgccagccggtccctcggacgggggtccctcggaccgtattctacgtcggctacggaacgtcgtacgcaccctcgaccgtccctcccgtggcctgcgaggtcggactcgagtcgnggaggngtgaggctagtacttattagttgtgtacgagggtcggggtaggggtacggttacggtacggttacgtggtcggttgtcggttggttcgggttccggtcggggacggggtaacggaaccgttaacgggtccgttaccggtaccggttccggttacgggttccgaccggtaacccggtaacggtcccgttcccggccccggttaccgttcccgttaaccgtttcccccg

SEQ ID NO: 388519 - DNA, 749 bp, Homo sapiens
  misc_feature: GZ8MTXP01AWVNM.11.67.G01.1.454.CMB.2.raw
  modified_base (199)..(199): a, c, t, g, unknown or other
  modified_base (203)..(203): a, c, t, g, unknown or other
  modified_base (210)..(210): a, c, t, g, unknown or other
  modified_base (214)..(214): a, c, t, g, unknown or other
  modified_base (253)..(253): a, c, t, g, unknown or other
tcagcgagagataccacgaccggtgctcgatttagagtatacatattggggtttggggggggttgagaagacaggactcaggacaatctccagcatggccagcttccctctcctcctcaccctcctcactcactgtgcagggtcctgggcccagtctgttctgactcacgccaccctcagcgtcgtcgggacccccggnaganactcacntctntagtacgtgagcagctacaatagtacggaaagtaacgtntgtataattgtactacaactcctcccgtaccccggtaccgacccctaactctacactactaagtagaactcgccgacggcccgtcccgtcgggtaccgggtccgtcggtccgtacgttccgtcgtcggacgtacggtaccgttcgtacggtaccacctccgtaccgccccgtcccggtcgggtcccgtcggccggtaggggttccgggtcccttaccgtacggttcgaggggtacggtacgtacgggtacgggtcgttaacgttaacgtttacgtttaggtcggtacggacggtcgggtcggggggttacggggtcggttacggtacgggttacggtcggtacggttcggttcggttcgggttacggggttccggtcgggggtacgggaaccgggtaccgttacggtccggttaccggtacccgggtccggttacgggccaccggtccgtaccggtcccgtcccggtccccggttacgttcccgttcccgttcccg

SEQ ID NO: 388520 - DNA, 631 bp, Homo sapiens
  misc_feature: GZ8MTXP01DIKG7.11.67.G01.1.454.CMB.2.raw
  modified_base (211)..(211): a, c, t, g, unknown or other
  modified_base (232)..(232): a, c, t, g, unknown or other
  modified_base (237)..(237): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtcgtcggggaccccccggnagagaatcacatctctgtacnggaancagctacaatagtacgaagtacgatgtacaattgtatacaacactccgtaccccggtaccgaccccctaaacctcctactatactaagtaaggaactacgaccgacggccggtccccgtcggaccggggtcccgtcggtacccccgtattcgtcgtcggtaccgtaacgaacgttccgtcggaccctaaccctacgaccgtccccgtcccgtcggccctgcgtaggtcggcctaccgagtcgtagagagtgagacgtagtacgttattagttgtgacgacgtcggtaggtagtcgtacggtcgtgtgtgtcgttggtcggttcggttcgggtacgggacgggaccgaacgtaacgtacggtccggtccgtcggttacgtaacgaacccgtaacg

SEQ ID NO: 388521 - DNA, 724 bp, Homo sapiens
  misc_feature: GZ8MTXP01E13O4.11.67.G01.1.454.CMB.2.raw
  modified_base (189)..(189): a, c, t, g, unknown or other
  modified_base (209)..(209): a, c, t, g, unknown or other
  modified_base (213)..(213): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (270)..(270): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcacgccaccctnagcgtcgcggggaccccggnaganaactcactatctcttagtacnggaacncanctacaatacgtacggaatacgatgtanaagttgtactacaactacgtcccgtaccccggtaccgaccccaactcctacactactaagtaacgactacgccgacgccggtacctcggacgggtcccgtcggtacccgtattcgtcgtcggtcctaacgacgtcgtcgaccctaccgtcaccgtccccgtccgtcggccgtcgacggtacgggtcggccttacgtacggtcgtagggaggtacgtacggacggtacgttacgtaacgtttaacgttaggttcgtacggtacgtacgggttcggggtaggtacgtcgggtaccggttcggtagggtcggttcggttcggtttacgggggttcggttaccgggttaccgggggaacggggttaaccggggttaaccgttaacgggtcccggttaccgggtaaccccggttacggggttcgggttaacccgtaacccgggaaccccgggtaacggg

SEQ ID NO: 388522 - DNA, 748 bp, Homo sapiens
  misc_feature: GZ8MTXP01CG1QQ.11.67.G01.1.454.CMB.2.raw
  modified_base (209)..(209): a, c, t, g, unknown or other
  modified_base (213)..(213): a, c, t, g, unknown or other
  modified_base (215)..(215): a, c, t, g, unknown or other
  modified_base (223)..(223): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcacgccaccctcagcgtcgtcgggaccccggnaganancacatctntgtactggagcagctacaaatagtacggaaagtaacgatgtactaagttagtactacaaactacttaccccgtacccccggtaacccgacccccctaaactccctactaactactaaagtaagtaactacgacccgaacggccgtccctaggaccggggttccctcggtaccccgtatttcgtcgtcggccttaaacggagttccgtacgggacctaaccctccgaaccgccccgttccgtacggccctgcgtaggtcggaccttaccgtagttcgtaggacgtagtcggaacgggtcttaacggttacttttaagttttacggttgtacggaaccggttgggtaccgggttggggtaaacgttcggggtaaacccggttgttgggtaagggttcggttcggttacggggttccgggttaccgggttcgggggaaacggggttaccgggaaccgttaacgggtccgtaccgggtaaccccggtttcgggcgggttaccccgtaaccgaaccccggttaacccggg

SEQ ID NO: 388523 - DNA, 817 bp, Homo sapiens
  misc_feature: GZ8MTXP01A3DY8.11.67.G01.1.454.CMB.2.raw
  modified_base (176)..(176): a, c, t, g, unknown or other
  modified_base (198)..(198): a, c, t, g, unknown or other
  modified_base (254)..(254): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctnagcgtcgtcggggacccccggnagagaatcaccatctcttgtactggaagcagctacaaatatacgggaaagtaacgntgtacaaattggtatcaacatcccgtcccccggtaaccggccccccaaatccctcatactaataggaaatcgccagccgccctcgacgggggtccctcgggccgtattccgtcgtcggctaccggtaaacgtccgtcggggacctaacccctcgtaaaccggtcccctttccccggtcgggtccccgttgggccccgtaaagggggtttccgggggcccttacccgtaacgggtttccggttacgggaaaggggtagttacgggggacgggttacccgttaggttaaaccgtttaacgttttaacgttgggttaacgccggtaaaggggtccgggggttagggggtaacgttacggggtaacggggtttccgtacgggaggttccggtcggttagggtttccgggggtaccggttttcgggggccgggggtaacgggtaaccggaacggtccggttaccgggtaacccggttccgggttacgggttcccgaaccgggtccccgaaccgggtcccgtccccggtccccccggttacgggttaaccccttccggttttcccccgg

SEQ ID NO: 388524 - DNA, 618 bp, Homo sapiens
  misc_feature: GZ8MTXP01DLJ47.11.67.G01.1.454.CMB.2.raw
  modified_base (241)..(241): a, c, t, g, unknown or other
  modified_base (334)..(334): a, c, t, g, unknown or other
  modified_base (360)..(360): a, c, t, g, unknown or other
  modified_base (502)..(502): a, c, t, g, unknown or other
  modified_base (577)..(577): a, c, t, g, unknown or other
tcagcgagagataccacgaccggtgctcgatttagagtatacatattgggtttggggggaagaggaagactgacggtcccccaggagttcaggtgctgggcacggtgggcatgtgtgagttttgtcacaagattttgggctcaactctcttgtccaccttggtgcagccgagggggtccctgagactctcctgtgtaggctctggattcagttttagcagctacgccatgacctgggtccncaggctcgagggagggctggagtggctggctataatggcaggtgcaagacatactacgcagagtccgtgcgacggccgatcgccacagttccncaagagactaactcccaaagacgacnctaacgtacctcgactaaaagtcgggaacacgtcgtgaaggacgacccggacgtaccgaacgtccgttaaatacttaacgttggacaccgtaaagaactcccgtaccaaagggtacttaagttcgacgaccgtggggttacncgtaaaacgtcggtaaccacggtacctacccttaattaactttacaccactaaactcgggttacgcccgttaggnggggtaacaacgggtccacggttactaacgttcgtaacccc

SEQ ID NO: 388525 - DNA, 745 bp, Homo sapiens
  misc_feature: GZ8MTXP01BL7IA.11.67.G01.1.454.CMB.2.raw
tcagcgagagataccacgaccggtgctcgatttagagtatacatagttggggggggcttggtgcagccgagggggtccctgagactctcctgtgtaggctctggattcagttttagcagctacgccatgacctgggtccgccaggctccgagggaagggctggagtgggtctcggctattaatcggccacggtggacaagacatactacgcagagtccgtgcgagggccatcgcaccatctccagagacaacttcccaagacgacgctgtacctgacaaagtggacagccgtagagacgccgacgacgtaccgggtcctaatacttacgtgtacgaccaaagtaaacttccccgtacaagtattacgttacgccccgtacggttggggacgtacccaaacgtccggaccgttaaccggacccttaccctaaacttacttacctccaaacccgtacctagtcgggtaccggtacggtacggggaaccgtaaacggggacctaaccgggttctaacgttccggtacctcccgtaccaccgtacccgtaccccgaaccgggaaccggtccccgtaaccggttccccggtccccgtttacccccggcggtcccctccccgttacctacccgaacgaaccgtcccgaaccgtcccggttaaggggccccgtaacggcccgttcccggggttcccgtcggggtcccgtcggttccccggtgggttaccgtaaccggttaaccgtttccccg

SEQ ID NO: 388526 - DNA, 577 bp, Homo sapiens
  misc_feature: GZ8MTXP01AIZIF.11.67.G01.1.454.CMB.2.raw
  modified_base (278)..(278): a, c, t, g, unknown or other
  modified_base (284)..(284): a, c, t, g, unknown or other
  modified_base (311)..(311): a, c, t, g, unknown or other
  modified_base (345)..(345): a, c, t, g, unknown or other
  modified_base (389)..(389): a, c, t, g, unknown or other
  modified_base (406)..(407): a, c, t, g, unknown or other
  modified_base (435)..(435): a, c, t, g, unknown or other
tcagcgagagataccacgaccggtgctcgatttagagtatacatattgggtttggggagctctgagagaggagcccagccctgggatttttcaggttgttttcatttggtgatcaggactgaacagagagagctcaccatggagtttggctgagcgtgtcgttttctaggtgcttaatttaaaggtgtcagtgtgaggtggagttattgctagtcgtgggggggcttggtgcaggccggaggggtccctgagtactctctgtgtggctcgtggacttnagttancagtcctacgcagtcgacgtcggtccncgaggctccgagggaggctggaggtggtctcggnttataagtcgccaggtgacagacaatacaacgcgagagtccggngcgacggcagcgacacnnccacgagacaactacgtaccagacgtcncgtacggacgacgacaacgtcgaacgcgtacgacgacgacgaccgaacgtaccgaacgtaccgttagtacgttcgtcgtaacgaccgttaacgaaccgtaaccgtacgaacgtacgttacgttcgtaacgttcggtaacggg

SEQ ID NO: 388527 - DNA, 495 bp, Homo sapiens
  misc_feature: GZ8MTXP01D2ZIH.11.67.G01.1.454.CMB.2.raw
  modified_base (480)..(495): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctgggggacaaacgggaccacggtcatcgtactccctcacgccctccacccgaacgggccccattccggtcctttccccccgtcggtaccccacccctcctcccaaacgacgccaccctcgtggggggccacgacgtcggcccgtggggcctgacctggtcaagactacttccgtatctctcgctgacgcgggcgtaggctaaggcgctatgnnnnnnnnnnnnnnnn

SEQ ID NO: 388528 - DNA, 725 bp, Homo sapiens
  misc_feature: GZ8MTXP01AF9UK.11.67.G01.1.454.CMB.2.raw
  modified_base (234)..(234): a, c, t, g, unknown or other
  modified_base (258)..(258): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccacctcagcgtcgtcggggaccccggagagaatcacatctcttgactggaancagctacaatcgtacggaatacgntgtacaattggtatacaacctacgtccctcccccggtaaccgaccccctaaactccctacatacctagtaaggtaactacgcccacggcccgtacccgtcggtaaccggggtcccctcgggtaccccgtactttcctcgtacggcttaacgggaacgtcgtacggtccctaacctccgtacgtccccgttcccgtcggcccgttggaccgtgggtcggggtcctccgtaggtcgtaggacggtacgtcgttcggacgtttacgtaactttaaggtttagttcggttcgaccggtaaggtcgggtagggtagttacggtaaccgggttcgttacggtgggttgtcgggtttgggttcggggttaccgggttccgggggacggggttaacgggttacccgttaacgggtccggttaccggtcccggttaccggtcggggttaccgtaaccggttaaccccggtaacggg

SEQ ID NO: 388529 - DNA, 518 bp, Homo sapiens
  misc_feature: GZ8MTXP02GY1KP.11.67.G01.1.454.CMB.2.raw
  modified_base (206)..(206): a, c, t, g, unknown or other
tcagcgagagataccacgaccggtgctcgatttagagtatacatattgggtttgggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctccaatatcggaagtaacgatgtcaattggatcaacatctccccggtacgcccccaaactcctcatctaataggaatagcccagccggccctcgaggggtccctggccccgattctctggctcgaagtctggcaccgtcacgccctccctggcctgcagtgggctcccagtctgaggatgaggctgactattatgtgcagcgtgggatggacggtctgagtgcgtgtcggtcttcggcggacggaccaagcgtggaccgtcgtcgggtcacgcccgaagg

SEQ ID NO: 388530 - DNA, 532 bp, Homo sapiens
  misc_feature: GZ8MTXP02JYM9F.11.67.G01.1.454.CMB.2.raw
  modified_base (311)..(311): a, c, t, g, unknown or other
  modified_base (410)..(410): a, c, t, g, unknown or other
  modified_base (456)..(456): a, c, t, g, unknown or other
  modified_base (466)..(466): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtcgttttcttagtggctattttaaaaggtgtccagtgtgaggtggagttattgcagtcgtggggggggcttggtgcagccggagggggtccctgagactctcctgtgtaggctctggattcagttttagcagctacgccatgacctgggtccnccaggctccaggggaaggggctgggagtgggtctcggctattaatggcccacggtgcaagcattacacgcagagtccgtgcaggggccgatgcaccacnctcccagagacaacttacccacgaagaacgctcgtactcgacaaanaggacagccngagagacgacgacgacggaccgatactaactcgtgacacaaacaacgtccacgactattgcacgtg

SEQ ID NO: 388531 - DNA, 536 bp, Homo sapiens
  misc_feature: GZ8MTXP02IZ338.11.67.G01.1.454.CMB.2.raw
  modified_base (172)..(172): a, c, t, g, unknown or other
  modified_base (191)..(191): a, c, t, g, unknown or other
  modified_base (219)..(219): a, c, t, g, unknown or other
  modified_base (240)..(240): a, c, t, g, unknown or other
  modified_base (257)..(257): a, c, t, g, unknown or other
  modified_base (383)..(383): a, c, t, g, unknown or other
  modified_base (397)..(397): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgtctgactcagccaccctnagcgtctgggacccccggnagagaatcaccatctcttgtactggaancagctcaatatcggaatacgntgtcaattgtatcaacntcctccccggtacgcccccaatcctacatctagtaggaatgccagccgccctcgacggggtcccctggccgtattcctcgtggccttcgaagtcctggccacctcacgccctccgtggccctgacnggtcggctcagtcngagatggagctgacttattagtgtgcaggtcggtagggtatcggacgggtctggagtgtcgtgtggtcgtcggtcggacggacgacgcgtcgtaccgtcgtcggtcgacgccgacgcgtcgtcccgtccgtcgtactcg

SEQ ID NO: 388532 - DNA, 578 bp, Homo sapiens
  misc_feature: GZ8MTXP02ID9K4.11.67.G01.1.454.CMB.2.raw
  modified_base (194)..(194): a, c, t, g, unknown or other
  modified_base (406)..(406): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaagcagctccaatatcggaaagtaacgatgtacaattggtatcaacatcctccccggtacgccccaaactcctcatctataggaatagccagccggccctcgacggggtcccctgggcccgtattctcgtggctcgaacgtcgtggcacctcacgccctcccgtggcctgccagtcggctccagtcngagatgagctgactattattgtgcgagtcggtgggatggacgggtctggagtgtcgttggttggttcgttcggggcgggtacgggaaccgaaggcgtacggacccgttccggtcggggttacacggccccgaaggcccgtccggccccccgtccgggtacctaccgttcccg

SEQ ID NO: 388533 - DNA, 520 bp, Homo sapiens
  misc_feature: GZ8MTXP02HBOAR.11.67.G01.1.454.CMB.2.raw
  modified_base (207)..(207): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctccaatatcggaagtaacgatgtcaaattggtatcaacatctccccggtacggcccccaaactcctcatctataggaatagccagcggccctcgacggggtcccctggccccgattctctggctcgaagtctggcacctcagcctccctggccctgccagtcgggctccgagtctgaggatgagctgactattatgtgcagcgtggatgacgtctgagtgctgtcggtcttcgggcggtagggaccaaggcgtggacccgtcgtggggtcacggcccaagg

SEQ ID NO: 388534 - DNA, 556 bp, Homo sapiens
  misc_feature: GZ8MTXP02GCYQ3.11.67.G01.1.454.CMB.2.raw
  modified_base (311)..(311): a, c, t, g, unknown or other
  modified_base (389)..(389): a, c, t, g, unknown or other
  modified_base (399)..(399): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtcgttttctaggtggctaattttaaaaggtgtccagtgtgaggtggagttattgcagtcgtgggggggcttggtgcagccggagggggtccctgagactctcctgtgtaggctctggattcagttttagcagctacgccatgacctgggtccncaggctccagggaagggctggagtgggtctcggctattaatggccccacggtggcaagcatactacgcagagtcccgngcgagggcancgcacactctcacgacgaacaactaccacgaacgacgacgtacgtacgtacgacgaaacgtacgacgacgacgtacgagacgaccgacgacgacgacgtactacttactacgtacgacgaacgaactaaccgtacgacgtactagtacgacacgtcg

SEQ ID NO: 388535 - DNA, 438 bp, Homo sapiens
  misc_feature: GZ8MTXP02IQWUB.11.67.G01.1.454.CMB.2.raw
  modified_base (434)..(438): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccacccaggcccatcggtcttccccctggccacccccctccaacgacgcaccctctgggggcacagcgccctgggctgcctgtcaggctacttcgtatctctcgctgagcgggctggcaggcgcatagnnnnn

SEQ ID NO: 388536 - DNA, 441 bp, Homo sapiens
  misc_feature: GZ8MTXP02F48O3.11.67.G01.1.454.CMB.2.raw
  modified_base (420)..(420): a, c, t, g, unknown or other
  modified_base (432)..(432): a, c, t, g, unknown or other
  modified_base (435)..(441): a, c, t, g, unknown or other
tcagcgagagataccacgaccggtgctcgatttagagtatacatattgggtttgggacccgggcagagaatcaccatctcttgtactggaagcagctccaatatcggaagtaacgatgtcaattggtatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtggggatgacggtctgagtgctgtggtcttcgggcggaggggaccaaagctgaccgtcctggggtcagcccaagggctgccccctggtcactctgttcccgccctcctcgtatctctcgctgagcggcgngcaggacgcganagnnnnnnn

SEQ ID NO: 388537 - DNA, 536 bp, Homo sapiens
  misc_feature: GZ8MTXP02I5T4G.11.67.G01.1.454.CMB.2.raw
  modified_base (195)..(195): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagcccaccctcagcgtcgtcgggacccccggnagagaatcaccatctcttgtactggaagcagctacaatatcggaagtaacgatgtcaattggtatcaacatcctccccggtacgcccccaaactcctcatctataggaatagccagccgccctgacggggtccctgggccgattcctcgtggctcgaagtcgtgcacctcacgccctccgtgcctgcagtggctcagtctgagatgagctgactattatgtgcagcgtggatggacggtctggagtgcgtggtggttcgttcgggcgggaacgggaccaaggcgtaggacccgtcgtcgggtcacgcccgaacggcgtcgcccccgtcggtccacgttccg

SEQ ID NO: 388538 - DNA, 611 bp, Homo sapiens
  misc_feature: GZ8MTXP02F90NY.11.67.G01.1.454.CMB.2.raw
  modified_base (207)..(207): a, c, t, g, unknown or other
  modified_base (235)..(235): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaancagcctaccaaatatacggaagtaacgatgtacaagttggtatacaacactcccgtcccccggtaccgacccccaaactcctacactactaagtaggaatacgccaggccggtccctcgacggggtccctggccccgtacttccgtcgtcggctacgaacgtcgtcggccacctcacgtccctcccgtcggccctgcgaggtcgggcctccgtagtcgtggaggtatggaggtctagtaacttagttagttgtagcgaggcggtagggagtcggacggttcgtggtagtcggtcgttggttcggttacggttcgggacgggaacgggaccgaacggtcgtacggacccggttcgtcggtccgacggacccgaacgg

SEQ ID NO: 388539 - DNA, 560 bp, Homo sapiens
  misc_feature: GZ8MTXP02J1BY0.11.67.G01.1.454.CMB.2.raw
  modified_base (314)..(314): a, c, t, g, unknown or other
  modified_base (333)..(333): a, c, t, g, unknown or other
  modified_base (376)..(376): a, c, t, g, unknown or other
  modified_base (388)..(388): a, c, t, g, unknown or other
  modified_base (400)..(400): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgtcgttttctaggtggctaattttaaaaggtgtccagtgtgaggtggagttattgcagtcggtgggggggtcttggtgcgagccggagggggtccctgagactctcctgtgtaggctcgtggattcagttttagcagctacgccatgacctgggtccncaggctccgagggagggcnggagtggtctcggcttatagtggccccaggtgcaagcattacncgcagagtccgngcgacgggcgancgcacactcaccgagacaactaactaccgaagaacgaccgactacgtaccgtagaacgaagtacgacgacgtacgagacgacgaccgacgacgacggacgtatacttacgtcgacgaccgaacgtaacgtccgtacagtactacgtacgtacgtacgtcg

SEQ ID NO: 388540 - DNA, 538 bp, Homo sapiens
  misc_feature: GZ8MTXP02JAYIR.11.67.G01.1.454.CMB.2.raw
  modified_base (308)..(308): a, c, t, g, unknown or other
  modified_base (407)..(407): a, c, t, g, unknown or other
  modified_base (442)..(442): a, c, t, g, unknown or other
  modified_base (459)..(459): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgtcgttttctgtggctattttaaaggtgtccagtgtgaggtggagttattgcagtcgtgggggggcttggtgcgagccggagggggtccctgagactctcctgtgtaggctctggattcagttttagctagctacgccatgacctgggtccncaggctccgagggaagggctggagtgggctcggctagtaatggcccacggtggcaagacattactcgcagtagtccgtgcgacgggccgatgcaccacnctccagagacactaccacgaacgacgctgtactanacaagtagacgacgccngagagaccgacgacgacgaccgtactataactagtcgaccaacgaactaaccgtacgacgactacgtacgacgacgtcg

SEQ ID NO: 388541 - DNA, 568 bp, Homo sapiens
  misc_feature: GZ8MTXP02JKALE.11.67.G01.1.454.CMB.2.raw
  modified_base (198)..(198): a, c, t, g, unknown or other
  modified_base (226)..(226): a, c, t, g, unknown or other
  modified_base (247)..(247): a, c, t, g, unknown or other
  modified_base (330)..(330): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagcccaccctcagcgtctcggggaccccccgggnagagaatcaccatctcttgtactggaancagctcaatatcggaatacgntgtcaattggtatcaacatcctccccggtacgcccccaaactcctcatctataggaatagccagcgccctcgacggggtcccngggccattctctggctcgaagtctggccacctcacgccctccctgggcctgccaggtcgggctccagtctgaggatgaggctgacttattattgtgcaggtcggtgggatggacgggtctgaggtgtcgttggtggttcgttcggggcggtacggggacccaaggtccgtacggacccggttccgtcggggtccacggcccgaagggccctccggcccccgtcggtccacgtttcccg

SEQ ID NO: 388542 - DNA, 623 bp, Homo sapiens
  misc_feature: GZ8MTXP02GSK4F.11.67.G01.1.454.CMB.2.raw
  modified_base (207)..(207): a, c, t, g, unknown or other
  modified_base (211)..(211): a, c, t, g, unknown or other
  modified_base (234)..(234): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnaganatcaccatctcttgtactggaancagcctaccaatagtacggaaagtaacgatgtactaaagttggtaatacaaactactcccgtacccccggtaaccgacccccaaactcctcatctaataggaatacgccaggccggccctcgacggggtccctggccccgtattcctcgtcggctacgaagtcgtggccacctcacgtccctcccgtggcctgcgaggtcgggcctccgagtcgtaggaggagtggacggtcgtagtaacttatttagttgtcgacgaggtcggtgggtagtcggtacggttcgtaggtacggtcgtcgttggttacgggttccggttcggggacgggacgggaaccgaaggtccgtacggtacccggttcggtacgggtaccaccggacccgtaacgg

SEQ ID NO: 388543 - DNA, 536 bp, Homo sapiens
  misc_feature: GZ8MTXP02JJL50.11.67.G01.1.454.CMB.2.raw
tcagcgagagataccacgaccggtgctcgatttagagtatacatattggggggtttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaactccgtcagatattgcactggtgcaactgctacgcgcctactattactcaccacatgacgtcgtggggcgaaagggaccacggtcatcgtctcctcagcctcaccaaggcccactcggtcctccccgtcggccaccctcctccaacgacgccacctccgtcgggggcacgacgccggccctcgggcgtcgtcgtcggtcaacggctacgtttcccg

SEQ ID NO: 388544 - DNA, 586 bp, Homo sapiens
  misc_feature: GZ8MTXP02F383Y.11.67.G01.1.454.CMB.2.raw
  modified_base (195)..(195): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagcccaccctcagcgtctgggacccccgggnagagaatcaccatctcttgtactggaagcagctccaatatcggaagtaacgatgtcaattggtatcaacatcctccccggtacggcccccaaactcctcatctataggaatagccagccggcccctcgacggggtcccctgggcccgtatttcctctgggccttcggaacgtctggccacctcacgccctccgtggccctgcaggtcggcctccagtctgagatgaggctgactattatgtgcgaggcggtgggatggacgggttctgagtgcgttggtcggttcgttcggggcgggtacgggaccgaaggtccgtacggacccggttccgtcggggtccacggccccgaaacgggccgttcccggcccccgtcggtcctaccgtttcccg

SEQ ID NO: 388545 - DNA, 536 bp, Homo sapiens
  misc_feature: GZ8MTXP02FQX3X.11.67.G01.1.454.CMB.2.raw
  modified_base (194)..(194): a, c, t, g, unknown or other
  modified_base (417)..(417): a, c, t, g, unknown or other
  modified_base (435)..(435): a, c, t, g, unknown or other
  modified_base (450)..(450): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctggggacccccggnagagaatcaccatctcttgtactggaagcagctccaaatatcggaaagtaacgatgtcaaattggtatcaacatcctccccggtacggcccccaaactcctcatctataggaatagccagccggccctcgacggggtcccctgggccatttctctggcctcgaacgtctggcacctcacgccctccctgggccctgcagtgggcctccagtctgagatgagcngactattattgtgcaggngtgggatggacggtntgagtgcgttggtggtcgttcgggcggagggaccagcgtcgaccgtcgtggtcacgccgaggcctcgccccctcggtcctactccg

SEQ ID NO: 388546 - DNA, 368 bp, Homo sapiens
  misc_feature: GZ8MTXP02HUS7W.11.67.G01.1.454.CMB.2.raw
  modified_base (366)..(368): a, c, t, g, unknown or other
tcagcgagagataccacgaccggtgctcgatttagagtatacatattgggtttgggaacctatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctggtcagcccaaggctcgccccctcggtcactctcgttcccaccctcctcgtactctctcgctgagccgggctggcaaggcgcatgnnn

SEQ ID NO: 388547 - DNA, 571 bp, Homo sapiens
  misc_feature: GZ8MTXP02IRDNC.11.67.G01.1.454.CMB.2.raw
tcagcgagagataccacgaccggtgctcgatttagagtatacatattgggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgacaaatggacagcctgagacgccgacgacacggccgtatattactgtcgccagaaactccgtacagatattcgcctacgtggtgcaacgtgctacgacgcctactattactcaccacatgacgtcgtggggacgaaagggaccgacggtcacgtcgtctcctcacgcctccaccgaacgggcccacgtccgtccttcccccgtcggcctaccccgtccctccgaacgaccgccaccgtcgtcgggggccaccgacggccggcccgtcgggctcggtccgtcggtaccgaacggtaccttaccg

SEQ ID NO: 388548 - DNA, 565 bp, Homo sapiens
  misc_feature: GZ8MTXP02G7259.11.67.G01.1.454.CMB.2.raw
  modified_base (208)..(208): a, c, t, g, unknown or other
  modified_base (236)..(236): a, c, t, g, unknown or other
  modified_base (321)..(321): a, c, t, g, unknown or other
  modified_base (431)..(431): a, c, t, g, unknown or other
  modified_base (477)..(477): a, c, t, g, unknown or other
  modified_base (543)..(543): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaancagctccaatatcggaagtaacgatgtcaaattggtatcaaactactccgtcccccggtaacggccccccaaactcctcatctanaggaatagcccagccgccctgacggggtccctggccccgattcctctcggctcgaagtcctggcacctcacgccctccctggcctgcagtcgggctccgagtctgacgangagctgacttatttagttgtgcgagtcggtggggatcggacggttntggagtcgtcgttggtcggttcgttcggggcggtacgggacccaaggtccgtcggaccggttccgnggggtaccacgacccgtaaggg

SEQ ID NO: 388549 - DNA, 586 bp, Homo sapiens
  misc_feature: GZ8MTXP02I38R1.11.67.G01.1.454.CMB.2.raw
  modified_base (193)..(193): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaattggtatcaacatctccccggtacggcccccaaactcctcatctataggaatagccagccggccctcgacggggtcccctgggcccgatttcctcgttggttcctttgtccctgaccacctcagccctccctggccatcactgggctccacgcctgagatgaggctgtattattactgtctagttcctttagactaatttaaacgtggtattgtaggtagtttcgggcgggtaacgggaccctaacggtaacccgttccgtaacggttccacggcccgtaaaggcctcgcccccgtcggtccaacgtctacgttccccacccttcctcgtactcc

SEQ ID NO: 388550 - DNA, 520 bp, Homo sapiens
  misc_feature: GZ8MTXP02IDDV4.11.67.G01.1.454.CMB.2.raw
tcagcgagagataccacgaccggtgctcgatttagagtatacatattgggggcttggtgcagccgagggggtccctgagactctcctgtgtaggctctggattcagttttagcagctacgccatgacctgggtccgccaggctccagggaagggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtcagatattgcactggtgcaactgctcgacgcctactattatcacacatgacgtctggggcaaagggaccacggtcaatcgtctcctcacgcctccaccaagggcccatccggtcttccccctcggccaccctcctccaacgacgcacctctcgggggcacgacgccgccctgggctcgcctggtcaaggacttaccg

SEQ ID NO: 388551 - DNA, 556 bp, Homo sapiens
  misc_feature: GZ8MTXP02G2M7Q.11.67.G01.1.454.CMB.2.raw
  modified_base (311)..(311): a, c, t, g, unknown or other
tcagcgagagataccacgaccggtgctcgatttagagtatacatattgggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattacngtgccagaaactccgtccagatattgccactggtgcaactgctacgacgcctactattactcaccacatgacgtcgtggggacaaacgggaccacggtcaactcgtctcctcacgcctccaccaacgggcccacgtccggtccttcccccgtcggccctacccctccctccaacgacgccacctcgtcgggggcacgacgccggcccgtcgggcctcggccgtcggtccgaacggactttacccg

SEQ ID NO: 388552 - DNA, 597 bp, Homo sapiens
  misc_feature: GZ8MTXP02GYXOQ.11.67.G01.1.454.CMB.2.raw
  modified_base (268)..(268): a, c, t, g, unknown or other
  modified_base (405)..(405): a, c, t, g, unknown or other
  modified_base (416)..(416): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgtcgttttctaggtggctaattttaaaggtgtcagtgtgaggtggagttattgcagtcgtgggggggcttggtgcagccggagggggtccctgagactctctgtgtaggctntggattcagtttagcagctacgccatgacctgggtcccgccaggcctccgaggggaacggggctgggagtgggtctcgggacttattaaagtcggccccacgggtggacaaaggacatactacggcagacgttccgngacgacggcancgaccacatccacgagacgaactaacgtaccgaagaacgtacgtactacgtaccgtagacgtaaagtcgaacacgacgagacgacgaccgacgaccgtacggtacgttaattacgtacgtacgtacgaccgtaaacgtaaccgtaaccgtacgtaagtactacgtacgtacgtacgtacgg

SEQ ID NO: 388553 - DNA, 584 bp, Homo sapiens
  misc_feature: GZ8MTXP02H5JWX.11.67.G01.1.454.CMB.2.raw
  modified_base (379)..(379): a, c, t, g, unknown or other
tcagcgagagataccacgaccggtgctcgatttagagtatacatattgggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggcctatattactgtcgaccagaaactccgtaccagatattgccacgtggtggcaactgacctcgaccgtcctactattacncaaccacatggacgtcgtacggggacgaaacggggaccacggtcacgtccgtctcctcacgtccctccaccaacgggcccacgttcccggtcccttcccccgtcggccctacccccgtcctacccgaacgacgccgacccgtccggtcgggggacaccgacggccggcccgtggcctcggccgtggtaccgaacggtacttaccg

SEQ ID NO: 388554 - DNA, 564 bp, Homo sapiens
  misc_feature: GZ8MTXP02HUT4M.11.67.G01.1.454.CMB.2.raw
  modified_base (185)..(185): a, c, t, g, unknown or other
  modified_base (274)..(274): a, c, t, g, unknown or other
  modified_base (282)..(282): a, c, t, g, unknown or other
  modified_base (290)..(290): a, c, t, g, unknown or other
  modified_base (315)..(315): a, c, t, g, unknown or other
  modified_base (320)..(320): a, c, t, g, unknown or other
  modified_base (332)..(332): a, c, t, g, unknown or other
tcagcgagagataccacgaccggtgctcgatttagagtatacatattgggtttgggagctctgagagaggagcccagccctgggattttcaggtgttttcatttggtgatcaggactgaacagagagagctcaccatggagtttgggctgagcgtgtcgttttctaggtggctaattttaaaggngtcagtgtgaggtggagttattgcagtcgtgggggggcttggtgcagccggaggggtccctgagactctcctgtgtagctctggattcngtttagtngcacgcancgcgtcggcgcgcgcgcgaggaggngtggnggtggtcgtcgngtagtagtcgccgacgtacgacgaacgacacgtacgtcgacgacgacgtccgtcgacgacggacgacgacgaccgacactccgtaccgacgaacgaacgtaactaccgaacgaacgacgtacgtacgtacgtacgtacgaacgtacgacgacgacgacgacgacgacgacgacgacgacgtatactactcgcgacacgacgtaacgtacgactactactacgacgtacgtcg

SEQ ID NO: 388555 - DNA, 441 bp, Homo sapiens
  misc_feature: GZ8MTXP02FR8TY.11.67.G01.1.454.CMB.2.raw
  modified_base (439)..(441): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccacccaagggcccatcggtcttccccctggcccaccctcctccagagcacctctgggggcacagcgccctggggctgcctggtcaaggactacttccgtatctctcgctgagcgggctggcaaggcgcatagnnn

SEQ ID NO: 388556 - DNA, 721 bp, Homo sapiens
  misc_feature: GZ8MTXP02F16GV.11.67.G01.1.454.CMB.2.raw
  modified_base (207)..(207): a, c, t, g, unknown or other
  modified_base (211)..(211): a, c, t, g, unknown or other
  modified_base (233)..(233): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnaganatcacatctcttgtactggaancagcctacaatagtacggaaagtaacgatgtactaaagttggtatacaactacgtcccgtaccccggtaaccgaccccctaaactcctacactactaagtaaggaactacgccacggcccggtcccctacggaccggggtcccgtcggaccccgtactttccgtcgtcggtcctaccggtaacgttccgtacggaccctacccgtccgaccgtccccttccccgtcgggtcccgttcgccgtacgggtccgggtacccttacccgtacggtcgttaggaacgggtagtacggacgggtacgttacgtaaactttaagtttagtttggtacggtacgtaagggtcgggtaggggtaacgttcgggtaccggttcgtacggtaggttcggtcggtttggttcgggttccggttacggggacggggtaacggaccgaacggtccgtaccggtacccggttccggtagggtaccgaccggtacccgtaacgg

SEQ ID NO: 388557 - DNA, 560 bp, Homo sapiens
  misc_feature: GZ8MTXP02I7Q9R.11.67.G01.1.454.CMB.2.raw
  modified_base (271)..(271): a, c, t, g, unknown or other
  modified_base (279)..(280): a, c, t, g, unknown or other
  modified_base (285)..(285): a, c, t, g, unknown or other
  modified_base (287)..(287): a, c, t, g, unknown or other
  modified_base (315)..(315): a, c, t, g, unknown or other
  modified_base (318)..(318): a, c, t, g, unknown or other
  modified_base (348)..(348): a, c, t, g, unknown or other
  modified_base (401)..(401): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgtcgtttctaggtggctattttaaaaggtgtcagtgtgaggtggagttattgcagtcgtggggggcgttggtgcgagccgaggggtccgtgagctctcctgtgtggctctggttntctgttgnngctcncntgcgtcggtcgcgcgcgcgaggaggcgnggngtggtcgtcgtcgtagtagtcgccgacggngacgacgacactactcgacgacgacgtcgtcgcgacggcgacgcgcacactcncgacgacgactactaccgacgaacgacgacgtacgtacgtacgacgaacgtacgacgacgacgtagagacgacgacgacgacgtacgtacgtacgttacgtacgtacgacgaacgtaacgtaaccgtaccgtacgtacgtacgtacgtacgtacgtcgg

SEQ ID NO: 388558 - DNA, 744 bp, Homo sapiens
  misc_feature: GZ8MTXP02GCQKZ.11.67.G01.1.454.CMB.2.raw
  modified_base (210)..(210): a, c, t, g, unknown or other
  modified_base (239)..(239): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggaccccccgggnagagaactcaccatctcttgtactggaancagcctacaatagtacggaaagtaacgatgtactaagttggtactacaactactcccgtaccccggtaccgaccccctaaactcctactacttactaagtaaggtaactacgacccgacggcccggtaccccgtacggtaccggggtcccgtcggaccccgtacttccgtcgtcggtccgtacggtaacgtccgtcggaccctacccgtaccgaccgtccccgttcccggtcgggtcccgtcggaccggtacgggtccgggtacccttacccgtacgtccggtagggaacgggtagtacgggacggtacgttacgttaaactttagtttagttcggtacggacgtacgggtcgggttagggtacgtacgggtacggttcgtaggtacggttcggtcggtttgggttcgggtttccgggttacgggggaccggggtaaccgggaaccgtaacggtccggtaccggtacccggttccggtacgggtaccgaccggtacccgtaacgg

SEQ ID NO: 388559 - DNA, 754 bp, Homo sapiens
  misc_feature: GZ8MTXP02JFR3Z.11.67.G01.1.454.CMB.2.raw
  modified_base (209)..(209): a, c, t, g, unknown or other
  modified_base (213)..(213): a, c, t, g, unknown or other
  modified_base (237)..(237): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcggggacccccggnaganactcacatctcttgtacgtggacncacgtcctacaatacgtacggaaagtaacgatgtactaagttgtactacaacactcccgtaccccggtacccgacccctaactcctacactactaagtagaactacgccgacgccggcccgtacggaccggggtcccgtcggaccccgtacttccgtcgtcggtacgtacgtacgtccgtcggaccctacccgtccgaccgtccccgttcccgtcggtcccgtcggaccgtacgggtccgggtacccttacccgtaggttccggtagggtaacggtacgtacgggtaacggtaccgttaacgttaaacgtttagtttacggtttcgggtacggaccggttacggggtcggggttacggggtacgttcgggtaccgggttcggtaggtacggttcggttcggtttcggggttccggggttccgggttacgggggaccgggggtaacgggtaacccgtacgggtccggttaccgggtacccggttccgggtaccgggtaccgaccggtacccggtacgg

SEQ ID NO: 388560 - DNA, 523 bp, Homo sapiens
  misc_feature: GZ8MTXP02G2CYO.11.67.G01.1.454.CMB.2.raw
  modified_base (193)..(193): a, c, t, g, unknown or other
  modified_base (422)..(422): a, c, t, g, unknown or other
  modified_base (438)..(438): a, c, t, g, unknown or other
  modified_base (442)..(442): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccaatctgttctgactcagccaccctcagcgtctggggaccccggnagagaatcaccatctcttgtactggaagcagctccaaatatcggaaagtaacgatgtcaattggaatcaaacatcctccccggtacggccccccaaaatcctcatctaataggaatagccagcggccctgaggggtcccctgggccgattctctggctcgaagtctgcacctcagcctccctgcctgcagtggctccagtctgagatgagctgactattattgtgcagngtggagtgaggtgtgngtgngtgtggtcgtcggcggacggacgacgcgtcgtaccgtcgtcgtcgacgaaccgacgacgtccgtcccgtccgtcgtactcg

SEQ ID NO: 388561 - DNA, 596 bp, Homo sapiens
  misc_feature: GZ8MTXP02IHPEI.11.67.G01.1.454.CMB.2.raw
  modified_base (193)..(193): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctcggggaccccggnagagaatcaccatctcttgtactggaagcagctaccaatatcgggaaagtaacgatgtacaattggtatcaaacactccgtccccggtaccggaccccccaaactcctacatcctaataggaatacgccagccggccctcgacggggtcccctgggcccgtattctcgtggcctcggaacgtccgtggccacctcacgccctcccgtgggcctggctaggtcgggcctccagtcgtaggaggatggaggtctagacttattattgtgcgaggcggtgggatggacgggttctgagtgtcgtggttgggtcgtcggggcggacgggacccgtaaggccgtacggacccgtcgtcgggtaccgacgcccgtaagggccctccgcccccgtcggtcctacgtcccg

SEQ ID NO: 388562 - DNA, 596 bp, Homo sapiens
  misc_feature: GZ8MTXP02HFZMG.11.67.G01.1.454.CMB.2.raw
  modified_base (192)..(192): a, c, t, g, unknown or other
  modified_base (219)..(219): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgactggaancagctccaatatcggaagtaacgatgtcaattggtatcaacatcctccccggtacgccccaaactcctcatctataggaatagccagccggccctcgacggggtcccctgggccgtatttcctcgttcggggccttcggaaacgttccgtcgggacctacccgttcaaccggtccccttccccgtggggccccttggccaggggttcggggccttcccgagttccgtggaggagtggagggtctggaacttatttagttgtgcaggcggttgggatgggcggtctgagtgctggtggtcgttcgggcggtaggaccaggctggaccgtccgtagggtcacgcccgaaggccttccgccccgtcggtccacgttcccg

SEQ ID NO: 388563 - DNA, 529 bp, Homo sapiens
  misc_feature: GZ8MTXP02GCU7P.11.67.G01.1.454.CMB.2.raw
  modified_base (208)..(208): a, c, t, g, unknown or other
  modified_base (351)..(351): a, c, t, g, unknown or other
  modified_base (374)..(374): a, c, t, g, unknown or other
  modified_base (432)..(432): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctccaatatcggaagtaacgatgtcaattggtatcaacatctccccggtacgcccccaaatcctcatctataggaatagccagcggccctcaggggtccctggccccattcnctggctcgaagtctggcactcancctccctggccctgcagtcgggcttccgagtctgaggatgagctgactattagtgtgngagcgtgggtatcggacggtctaggagtgtcgttggtcggtcgttcgggcgggacggtaccaaggcgtcgaccgtcgtggtccacggacccgaacgg

SEQ ID NO: 388564 - DNA, 624 bp, Homo sapiens
  misc_feature: GZ8MTXP02GQ9OB.11.67.G01.1.454.CMB.2.raw
  modified_base (264)..(264): a, c, t, g, unknown or other
  modified_base (271)..(271): a, c, t, g, unknown or other
  modified_base (292)..(292): a, c, t, g, unknown or other
  modified_base (335)..(335): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgtgtttctaggtggctaatttaaaggtgtcagtgtgaggtggagttattgcagtcgtgggggggcttggtgcagccggaggggtccctgagactctcctgtgtggctntggattntagtttagtcagcgtacgccnctcgtaccgtcggtccgccgacgcgtcggaggagggcggtggnggtggtcgtcgtcgtagtagtcggcccgacggtacggacgaacgacgactaacgtcgacgacggacgtccgtcgacggacggacgacgtacgaccacctacgtacgtaccgacgacgaacgtaaccgtaaccgaacgaacgacgtaccgtaccgtacgtacgaacgaacgtacgacgacgacgtacgacgacggaccgacgacgaaccggtacgtacttacgttacgtacgtacgaccgaacgtaacgtaaccgtaccgtaacgtacgtacgttacgtacgtacgtcgg

SEQ ID NO: 388565 - DNA, 551 bp, Homo sapiens
  misc_feature: GZ8MTXP02IARH0.11.67.G01.1.454.CMB.2.raw
  modified_base (285)..(285): a, c, t, g, unknown or other
tcagcgagagataccacgaccggtgctcgatttagagtatacatattgggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccatgcaccatctccagagacaattcccagaagacgctgtacctgcaaatggacagcctgagngcccgacgacacggccgtatattactgtgccagaaactccgtccagatatgccactggtgcaactgctcgccgcctactattatcaccacatggacgtcgtggggacaaagggaccacggtcatcgtctcctcacgccctcccaccgaacggcccacgtccggtccttcccccgtcggcccaccctccctccaacgacgccacccgtcgtcgggggcaccgacgccggcccgtgggctcggccgtcggacgtaacggactttaccg

SEQ ID NO: 388566 - DNA, 543 bp, Homo sapiens
  misc_feature: GZ8MTXP02IO00X.11.67.G01.1.454.CMB.2.raw
  modified_base (195)..(195): a, c, t, g, unknown or other
  modified_base (223)..(223): a, c, t, g, unknown or other
  modified_base (422)..(422): a, c, t, g, unknown or other
  modified_base (443)..(443): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaancagctcaatatcggaataacgatgtcaattggtatcaacatcctccccggtacggcccccaaactcctcatctataggaatagccagccggcccctcgaggggtcccctgggccgtattctctggctcgaagtctgcacctcacgccctcccgtgcctgccaggtcgggctccagtctgagatgagctgactattatgngtcagcgtgggatgacggtcngagtgcgtgtggtcgttcggcggacggaccgaagctcggaccggttcgtacggggtcacggcccgaacggcctccggcccccgtcggtccacgtttcccg

SEQ ID NO: 388567 - DNA, 451 bp, Homo sapiens
  misc_feature: GZ8MTXP02GEZ0S.11.67.G01.1.454.CMB.2.raw
  modified_base (443)..(451): a, c, t, g, unknown or other
tcagcgagagataccacgaccggtgctcgatttagagtatacatattgggtttggggacccccgggcagagaatcaccatctcttgtactggaagcagctccaatatcggaagtaacgatgtcaattggtatcaacatctccccggtacggccccaaactcctcatctataggaatagccagcggccctcaggggtccctggccgattctctggctcgaagtctggcacctcagcctcctggcctgcagtgggctccagtctgaggatgaggctgactattatgtgcagcgtgggatgacggtctgagtgctgtggtcttcgggcggaggaccaagctcgaccgtcgtggtcacgcccaaggcctccgccccctggtccactctcgttccccgccctcctcgtactctctcgctgcgcggcgcggacgaacggcgacagtagnnnnnnnnn

SEQ ID NO: 388568 - DNA, 583 bp, Homo sapiens
  misc_feature: GZ8MTXP02ICV05.11.67.G01.1.454.CMB.2.raw
  modified_base (173)..(173): a, c, t, g, unknown or other
  modified_base (192)..(192): a, c, t, g, unknown or other
  modified_base (372)..(372): a, c, t, g, unknown or other
  modified_base (414)..(414): a, c, t, g, unknown or other
  modified_base (453)..(453): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccacctnagcgtctgggacccccggnagagaatcaccatctcttgtactggaagcagctaccaatatcggaataacgatgtacaattggatcaaacatccgtccccggtaccgcccccaaactcctcatctataggaatagccagcgcctgagggctcgcgactctctgcgctacgtactcgcgactctacgcctcccctcggtcnccgtcgagtcgggtctcctacgtcgtcgtaggagtagacggngtcgtacgtaattaagtttgtgccgagtcggtgggtagngtacgggtcgtgtaggtgtcgtggttggtcggttacggcgggacggacggtacgacgtcggtaccggtccgtcgggttacgaccgaaccgtaaccggcgtcccgccccgttcccggtctacccgttcccg

SEQ ID NO: 388569 - DNA, 594 bp, Homo sapiens
  misc_feature: GZ8MTXP02FS8DA.11.67.G01.1.454.CMB.2.raw
  modified_base (195)..(195): a, c, t, g, unknown or other
  modified_base (452)..(452): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaagcagctccaatagtcggaagtaacgatgtacaattggtatcaacatcctccccggtacgccccaaactcctcatctataggaatagccagcgccctgacggggtccctggccattctcgtggctcgaacgtctggcacctcacgccctccgtggcctgccaggtcgggctccagtctgaggatggagtctgtaacttattagttgtgcgaggcggtagggatggacggtntggagtggcttggtcggttcgttacgggggcgggtaacgggacccaaggtccgtacggtacccggttccggttacggggtccgaacggaaccccggtaacggcccgttcccggccccccgttacggtcctacccgtttcccg

SEQ ID NO: 388570 - DNA, 534 bp, Homo sapiens
  misc_feature: GZ8MTXP02I24WL.11.67.G01.1.454.CMB.2.raw
  modified_base (195)..(195): a, c, t, g, unknown or other
  modified_base (439)..(439): a, c, t, g, unknown or other
  modified_base (528)..(528): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaagcagctccaatatcggaaagtaacgatgtacaattggtatcaacatcctccccggtacgcccccaaactcctcatctataggaatagccagccgccctcgacggggtccctggccgattctcgtgctcgaagtctggcacctcacgccctccgtgcctgcaggtcggctccagtctgagatgagctgactattatgtgcagcggtggatggacggtntggagtgcgttggtggttcgtcgggcggtacggaccaaggcgtgaccgtccgtgggtccacggcccgaggcctccgccccgtcggtccncttccg

SEQ ID NO: 388571 - DNA, 527 bp, Homo sapiens
  misc_feature: GZ8MTXP02JX7KR.11.67.G01.1.454.CMB.2.raw
  modified_base (410)..(410): a, c, t, g, unknown or other
  modified_base (415)..(415): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggaccccccgggcagagaatcaccatctcttgtactggaagcagctccaatatcggaagtacgatgtcaattggtatcaacatcctccccggtacgcccccaaatcctcatctataggaatagccagcgccctcacggggtccctggccccgattctctggctcgaagtctggcacctcacgccctccctggccctgcagtcgggctccagtcngaggntgaggctgactattattgtgcagcggtgggactgacggtctgagtgtctggtcggtcttcgggcggtacgggaccaggcgtcggaccgtcgtgggtcacggacccgtaacgg

SEQ ID NO: 388572 - DNA, 542 bp, Homo sapiens
  misc_feature: GZ8MTXP02F5QPZ.11.67.G01.1.454.CMB.2.raw
  modified_base (194)..(194): a, c, t, g, unknown or other
  modified_base (245)..(245): a, c, t, g, unknown or other
  modified_base (354)..(354): a, c, t, g, unknown or other
  modified_base (362)..(362): a, c, t, g, unknown or other
  modified_base (371)..(371): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctccaatatcggaataacgntgtcaattggtatcaacatcctccccggtacggcccccaaaatcctcatctataggaatgccagccggccctcgaggggtcccctggccattcctctggctcgaagtcnggcacctnacgcctccnggcctgcagtgggctcagtctgagatggagctgacttattagttgtgcgaggcggtgggatggacggttctggacgtgcgttggtggtcgttcgggcgggacgggacaaggcctaggacccgtccgtgggtcacgccgaacggcctcgcccccgtcggtcctacgttcccg

SEQ ID NO: 388573 - DNA, 529 bp, Homo sapiens
  misc_feature: GZ8MTXP02IJYUG.11.67.G01.1.454.CMB.2.raw
tcagcgagagataccacgaccggtgctcgatttagagtatacatattggggggtttggtgcagccgaggggtccctgagactctcctgtgtaggctctggattcagttttagcagctacgccatgacctgggtccgccaggctccagggaagggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaaatccgtccagatattgcacctggtgcaactgctacgcgcctactattatcacacatgacgtctgggcaaagggaccacggtcatcgtctcctcacgcctccaccaacgggcccatccggtccttcccctcggccaccctcctccaacgacgcacctctcgggggcacgacgccggccctgggctcgtctcggtcaacggtactactttccg

SEQ ID NO: 388574 - DNA, 447 bp, Homo sapiens
  misc_feature: GZ8MTXP02JZZUZ.11.67.G01.1.454.CMB.2.raw
  modified_base (327)..(327): a, c, t, g, unknown or other
  modified_base (436)..(436): a, c, t, g, unknown or other
  modified_base (439)..(447): a, c, t, g, unknown or other
tcagcgagagataccacgaccggtgctcgatttagagtatacatattgggtttggggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtggctccagtctgaggatgaggctgactattattgtgcagcgtgggatgacggtctgagtgctgtggtcttcgggnggagggaccaagctggaccgtcgtgggtcagcccaaggcctcgccccctggtcactctcgttccccgccctcctcgtatcctctcgctgagcgggctggcaaggcgcanagnnnnnnnnn

SEQ ID NO: 388575 - DNA, 370 bp, Homo sapiens
  misc_feature: GZ8MTXP02I2UNQ.11.67.G01.1.454.CMB.2.raw
  modified_base (237)..(237): a, c, t, g, unknown or other
  modified_base (364)..(364): a, c, t, g, unknown or other
  modified_base (369)..(370): a, c, t, g, unknown or other
tcagcgagagataccacgaccggtgctcgatttagagtatacatattgggtttgggaacctatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtntgagtgctgtggtcttcggcggagggaccaagctgaccgtcctgggtcacgcccaaggcctgccccctcggtcacctctcgttccccgccctcctccgtatctctcgctgacgcggctggcaaggcncatgnn

SEQ ID NO: 388576 - DNA, 687 bp, Homo sapiens
  misc_feature: GZ8MTXP02JCP42.11.67.G01.1.454.CMB.2.raw
  modified_base (174)..(174): a, c, t, g, unknown or other
  modified_base (196)..(196): a, c, t, g, unknown or other
  modified_base (226)..(226): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctnagcgtctcggggaccccccggnagagaactccaccatctcttgtactggaancagcctaccaaatagtacggaaagtaacgatgtactaagttggtatacaacactcccgtaccccggtaccgaccccctaaactccctacactactaagtaaggaactacgaccgacggccggtcccgtcggacggggtccctcgggccgtattccgtcgtcggctacgacgtcgtcgaccacctcgacgtccctccgtcgcctgcgtaggtcggcctcgacgtcgtaggacggtagtggacgtacgtacgtaacttagtttagttcgtgtacgtacggtcgggtagggtagtacgggtacgggttgtaggtagttcggtcggttggttcgggttccggttcgggggacgggtaacgggaaccgtaacggtccggtacggtacccggttccggtacggggtaccgaaccggtaacccgaacgggtccgtccccggtcccccgttcggtacctacccgttccg

SEQ ID NO: 388577 - DNA, 619 bp, Homo sapiens
  misc_feature: GZ8MTXP02IQSIA.11.67.G01.1.454.CMB.2.raw
  modified_base (312)..(312): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggctattttaaaggtgtccagtgtgaggtggagttattgcagtcgtgggggggcttggtgcagccggagggggtccctgagactctcctgtgtaggctcgtggtattcagttttagcagcctacgcccatcgacctgggtcccnccgaggcctcccgaaggggaaggggcgtgggaggttcggggtctcgggtcttagttaagtcggaccccgacgggtgacaagacactactcgcagacgtcccgtgcgacggggccagtcgacctacactctcccagacgaactactacccgagaacgaccgcttgtaccctgaccaaaagtcggaactacgcctaggaacgacgaccgaacgaccgaaccgggccgttaaacttactttaccgtaggttacgacccgtaagtaaaaccgtcccgtaccgtaagacgttattcggacctacgttcgggg

SEQ ID NO: 388578 - DNA, 563 bp, Homo sapiens
  misc_feature: GZ8MTXP02FQ43A.11.67.G01.1.454.CMB.2.raw
  modified_base (209)..(209): a, c, t, g, unknown or other
  modified_base (449)..(449): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtcgtcgggacccccggnagagaatcaccatctcttgtactggaagcagctaccaatatcggaagtaacgatgtcaattggtatcaactatccctacccccggtaccggaccccccaaaactccctacatacctataaggaatacgcccagccggcccctcgacggggtcccctggccccttacttcctctggccttacgaagtccgtaggccacctcacgcccttcccgtggcctgcagtcggctccgagtctgagntgagctgacttattagtgtagcaggcgtgggatgacggttctgagtgcgttggtcggtcgttcgggacgggtacggaccaaggccgtacggccgtcgtggtcacgtaccgacgg

SEQ ID NO: 388579 - DNA, 652 bp, Homo sapiens
  misc_feature: GZ8MTXP02GVT3O.11.67.G01.1.454.CMB.2.raw
  modified_base (174)..(174): a, c, t, g, unknown or other
  modified_base (193)..(193): a, c, t, g, unknown or other
  modified_base (197)..(197): a, c, t, g, unknown or other
  modified_base (220)..(220): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctnagcgtctgggacccccggnaganaatcacatctcttgtactggaancagctacaatagtacggaaagtaacgatgtacaagttggtatacaaacactccgtacccccggtaaccggaccccccaaactcctacactactaataaggaatacgaccacggccggcccctcggacggggtccctgggccgtattcctcgtggcctacgaacgtcgtggccacctcgacgtccctcccgtgcctgccgtaggtcgggcctccgagtcgtaggaggtatggagctgaacttatttagttgtgcgaggtcggtggggtatcgggtacggttcgtaggtaggttgtcgttggttcgggttccgttcgggggacgggtaacggggtaccgaaaggtccgtacggtaacccggttccggtacggggtaccaaccggaacccgaaacgggtccctcccggaccccccgttcggtcctacccgttccg

SEQ ID NO: 388580 - DNA, 443 bp, Homo sapiens
  misc_feature: GZ8MTXP02FQO1Z.11.67.G01.1.454.CMB.2.raw
  modified_base (414)..(414): a, c, t, g, unknown or other
  modified_base (430)..(443): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaggcccatcgtctcccctggccaccctcctcaagacgcacctctgggggcacagcggccctgggctgcctggtcaaggctacttccgatctctcgctgagcggntggcaaggcgcatagnnnnnnnnnnnnnn

SEQ ID NO: 388581 - DNA, 538 bp, Homo sapiens
  misc_feature: GZ8MTXP02GGLP3.11.67.G01.1.454.CMB.2.raw
  modified_base (196)..(196): a, c, t, g, unknown or other
  modified_base (224)..(224): a, c, t, g, unknown or other
  modified_base (401)..(401): a, c, t, g, unknown or other
  modified_base (409)..(409): a, c, t, g, unknown or other
  modified_base (437)..(437): a, c, t, g, unknown or other
  modified_base (451)..(451): a, c, t, g, unknown or other
tcagcgagagataccacgaccggtgctcgatttagagtatacatattggggtttggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaancagctaccaatatcggaagtaacgatgtcaattggtatcaacatctccccggtacggcccccaaactcctcatctataggaatagcagcgccctcgaggggtccctggccattcctctggttccttgtccctgaccacctcagtccctcctggccatcactgggctcagcctgagangaggctgnttatactgtcagttcttgactattaacngtatgtgtatcggnggacggacctacggtaccgtcctacggtcacgcccgaagctaccgcccctcggtccaacgtctccgtcccaccctcctcgtacttcc

SEQ ID NO: 388582 - DNA, 610 bp, Homo sapiens
  misc_feature: GZ8MTXP02HJ3Y1.11.67.G01.1.454.CMB.2.raw
  modified_base (307)..(307): a, c, t, g, unknown or other
  modified_base (524)..(524): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggcttatttaaaggtgtccagtgtgaggtggagttattgcagtcgtggggggggcttggtgcagccggagggggtccctgagactctcctgtgtaggctctggattcagttttagcagctacgccatgacctgggtccnccgaggctccgagggaagggctggagtgggctcggctataatggcccaggtgcaagcatactcgcagagtccgtgcagggccatgcacatctcccagacgacaacttccaacgaagacgctacggtaccctagaccaaagtcggaacacgccctaggaacggacgacccggaacgaacccgtaaccgggggtacccgttaaattaactttaaaccgnggtttaacggaccccaagggtaaaaacttaaccccggttacccaaacggtaagttaacctttaggacccgttaaagtttccggggg

SEQ ID NO: 388583 - DNA, 571 bp, Homo sapiens
  misc_feature: GZ8MTXP02GJIJN.11.67.G01.1.454.CMB.2.raw
  modified_base (245)..(245): a, c, t, g, unknown or other
  modified_base (307)..(307): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggctattttaaaaggtgtccagtgtgaggtggagttattgcagtcgtgggggggcttggtgcagccgaggggtcccngagactctcctgtgtaggctctggattcagttttagcagctacgccatcgacctgggtcccnccgaggctccgaggggaaggggctggagtgggtctcgggctagttaaatggccccgacggtggcaaggacatactcgcagagtccgtgcgagggcccgatcgccacactacctcccaagacgaacaacttaccccagaacgacgcctagtacctgacaaagtggacacgcctgagacgaccgacgaaccgacggacccgtaatacgttaacgtgtacgaccgaagaaaactccggtaccaagtactagtttacacgacgttcgg

SEQ ID NO: 388584 - DNA, 593 bp, Homo sapiens
  misc_feature: GZ8MTXP02HSDRA.11.67.G01.1.454.CMB.2.raw
  modified_base (195)..(195): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagccgtctcgggacccccggnagagaatcaccatctcttgtactggaagcagctccaatatcggaaagtaacgatgtacaattggtatcaacatcctccccggtacgcccccaaactcctcatctataggaatagccagccggccctcgacggggtccctggccgtattctctggctcgaacgtctggcacctcacgcctcccgtggcctgccaggtcggctccagtctgagagtggagctagacttattattcgtgcgaggtcgtgggtagtggacggttcgtggtaggtcggtcgtggttcgggttcgttcggggcgggtacggggacccgtaaaggcgtcggtaccgttccgtcggggtccgaacggcccgtaaacgggccgttccggcccccgttccggtccgtaccgtttcccg

SEQ ID NO: 388585 - DNA, 683 bp, Homo sapiens
  misc_feature: GZ8MTXP02HF37L.11.67.G01.1.454.CMB.2.raw
  modified_base (188)..(188): a, c, t, g, unknown or other
  modified_base (208)..(208): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctnagcgtctcgggacccccggnagagaatcaccatctcttgtactggaagcagctccaatatcggaagtaacgatgtcaattggatcaacatcctccccggtacgcccccaaactcctcatctataggaatagcccagccggccctcgacggggtccctggccccgtattctctggctcgaacgtcgtggccacctcgacgtccctcctcggcccttgcccgtagtcggggacctcccgacgttcctaggacggtatggaacggtccgtaggtaaccttagtttagttcgtacggtccgtaaggtccgggtaggggtacgtacgggtaaccgggttaccgttgggtaacggttcggtcccggtttggggtttacggggttccgtttccgggggaccgggggtaaccggggtaaccccgtaaaagggtcccggttacggggtaaccccggtttcccggtcgggggttacccgtaaccgggcccccggtaaaaccgggg

SEQ ID NO: 388586 - DNA, 716 bp, Homo sapiens
  misc_feature: GZ8MTXP02JH4M9.11.67.G01.1.454.CMB.2.raw
  modified_base (196)..(196): a, c, t, g, unknown or other
  modified_base (202)..(202): a, c, t, g, unknown or other
  modified_base (206)..(206): a, c, t, g, unknown or other
  modified_base (213)..(213): a, c, t, g, unknown or other
  modified_base (218)..(218): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccggaganatcacntctnttgtacnggaancagcctacaatagtacggaaagtaacgatgtactaagttggtaatacaactactcccgtaccccggtaccgaccccctaaactcctacactactaagtaaggaatacgaccgacggccggccctacggtaccggggttcccctcgggccgttacttccgtcgtcggccgtacggtaaccgtcgtcgcctacctcgaccggtccccttcccgtcgggtcccttcggaccgtacgggttcggggccttacccgacgttcgtaggagggtagtacgggacggtctagtaacgtttaagtttagttggtcgacgtagggtcgggtaggggtagtacgggtaccgggttgtcggtaggttcggtcgttcgggttcgggttaccgggtcggggacggggtaaccgggtaccgaacggtccggtaccggtaccggttccggtacgggtaccgaccggaacccggaacggtcccgtcccggtccccggtccggtcctaccgttccg

SEQ ID NO: 388587 - DNA, 535 bp, Homo sapiens
  misc_feature: GZ8MTXP02GBTV7.11.67.G01.1.454.CMB.2.raw
  modified_base (307)..(307): a, c, t, g, unknown or other
  modified_base (403)..(403): a, c, t, g, unknown or other
  modified_base (495)..(495): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttctgtggctatttaaaaggtgtccagtgtgaggtggagttattgcagtcgtggggggggcttggtgcagccggagggggtccctgagactctcctgtgtaggctctggattcagttttagcagctacgccatcgacctgggtccnccaggctccgaggggagggctggagtgggtctcggctagttaatggcccacggtgcaagacatactcgcagagtccgtgcagggccatgcacatcnccagacgaacaacttcccaagagacgctagtaccctgaccaaaatggaacagcctagacgacgaccgacgaccacggaccgtatacttacgngtcgacagaaaactccgtaccagtactattcgcacgtggg

SEQ ID NO: 388588 - DNA, 561 bp, Homo sapiens
  misc_feature: GZ8MTXP02I1SCX.11.67.G01.1.454.CMB.2.raw
  modified_base (424)..(424): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcagtcggtggggggggtcttggtgcgaggccggagggggtccctgagctctcctgtgtaggctcgtggattctagttttagcagctacgccatcgaccgtgggtcccgcgaggcctccgaggggaggggctggagtgggtctcggcttataagtggccccgaggtgacaagacatactacgcagacgtccgtgcgagggccagtgcaccatcnccagacgacactacccagaacgacgctagacctgaactaaagcggaacacgtcctaggaacgacgacccgaacgacgacggtccgtaatacttactgtacgaccagaaactccgtacagaacttgtacgcacgttgg

SEQ ID NO: 388589 - DNA, 666 bp, Homo sapiens
  misc_feature: GZ8MTXP02I2I3O.11.67.G01.1.454.CMB.2.raw
  modified_base (208)..(208): a, c, t, g, unknown or other
  modified_base (212)..(212): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccggnaganaactccaccatctcttgtacgtggaacgcagctaccaatacgtacggaagtaacgatgtactaagttgtatacaactactcccgtaccccggtaccgaccccctaaactcctactactactaagtaggaactacgaccgacgccggtcccgtacggacgggtcccgtcggccccgtattccgtcgtcggtctacggtaacgtcgtcggcctaccgtcgaccgtccctccgtcgcctcgcgtaggtcggcctccgtagtcgtaggacggtagtggacgtacgtagtaactttagtttgtggtacgacgtaggtcggtaggggtacgtacgggtacggttcgtaggtacggtcgtcgggtttggttcgggttaccggttcggggacgggtaacgggtaccgtaacggtccgtacggtacccggttccggtacgggtaccgaccggacccgtaacgg

SEQ ID NO: 388590 - DNA, 709 bp, Homo sapiens
  misc_feature: GZ8MTXP02IVJIN.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaggtgtccagtgtgaggtggagttattgcagtcgtgggggggcttggtgcagccggaggggtccctgagactctcctgtgtaggctctggattcagttttagcagctacgccatgaccgtgggtccgccaggcctcccgaaggggaaggggcgtgggaggttcggggtctccggggcttaagttaaagtcgggtaccccgaacggggttcggacgaaaaggactaagttaaccctacgggaccaaggacggttcccgtggacgaacgggggcccgaagtcggacccacccgaacttccctacccgaagaacgaactaaacctttacccgaaacccccgaaaggaaccggtaccgttacggttaaccccgttacggaaccctaaaagttaccggggaaacctacggacccgtagggaaacggacggaaccccggaacgaaccgaaccgggccgttaaagttactttaccgtagttacgaacctaacgaaaacttcccggtaccaaggtactaattcgactaacgttcggg

SEQ ID NO: 388591 - DNA, 513 bp, Homo sapiens
  misc_feature: GZ8MTXP02IN5Q5.11.67.G01.1.454.CMB.2.raw
  modified_base (207)..(207): a, c, t, g, unknown or other
  modified_base (382)..(382): a, c, t, g, unknown or other
  modified_base (397)..(397): a, c, t, g, unknown or other
  modified_base (413)..(413): a, c, t, g, unknown or other
  modified_base (450)..(450): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctaccaatatcggaagtaacgatgtcaattggtatcaacatctcccccggtaccggaccccccaaactcctcatctataggaatagccagcgccctcgacggggtccctggccccgtattcctctggctcgaatctgcacctcncgcctcctggctgcngtcggctccagtctgngatgagctgactattatgtagcagcgtggatgcgtcngagtgctgtcggtcttcgggcggacggtaccaagctacggaccgtcgaggtcacggaccacgg

SEQ ID NO: 388592 - DNA, 539 bp, Homo sapiens
  misc_feature: GZ8MTXP02JYQN7.11.67.G01.1.454.CMB.2.raw
  modified_base (368)..(368): a, c, t, g, unknown or other
  modified_base (374)..(374): a, c, t, g, unknown or other
tcagcgagagataccacgaccggtgctcgatttagagtatacatattggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgagacacggccgtatattactgtgccagaaactccgtccagatatgccactggtgcaactgctacgacgcctactattancaccanatgacgtcgtggggcaaagggaccacggtcatcgtctcctcacgcctccaccaacgggcccagtccgtccttccccctcggccacccctcctcccaacgacgccacctcgtcgggggccacgacgccggcccgtgggccgtcgccgtcggtcaacggacttaccg

SEQ ID NO: 388593 - DNA, 521 bp, Homo sapiens
  misc_feature: GZ8MTXP02IWJR9.11.67.G01.1.454.CMB.2.raw
  modified_base (194)..(194): a, c, t, g, unknown or other
  modified_base (246)..(246): a, c, t, g, unknown or other
  modified_base (437)..(437): a, c, t, g, unknown or other
tcagcgagagataccacgaccggtgctcgatttagagtatacatattgggtttgggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaagcagctccaatatcggaagtaacgntgtcaattggtatcaacatcctccccggtacgccccccaaatcctacatctataggaatagccagcgccctgaggggtcccctggccgattctctggctcgaagtctggcacctcacgcctccgtggcctgcagtggctcagtctgagatgagctgactatattgagcgagcgtgggtatgacggtctagngtgcgtgtggtcttcgggcggacggacaaggctcgaccggtccgtggtccagcccgaaggctcccgcccctcggtcactttccg

SEQ ID NO: 388594 - DNA, 548 bp, Homo sapiens
  misc_feature: GZ8MTXP02GL69X.11.67.G01.1.454.CMB.2.raw
  modified_base (307)..(307): a, c, t, g, unknown or other
  modified_base (350)..(350): a, c, t, g, unknown or other
  modified_base (384)..(384): a, c, t, g, unknown or other
  modified_base (457)..(457): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggctattttaaaaggtgtccagtgtgaggtggagttattgcagtcgtggggggggcttggtgcagccggagggggtccctgagactctcctgtgtaggctctggattctagtttagcagctacgccatgacctggtccncaggctccgagggaggggctggagtgggtctcggctattaagnggcccaggtgacaagacatactcgcagagtccgngcagggccgatcgcaccatcctcagacgaacaactcccgaagaacgacgctagtaccctgacaaagtcgaacncgcctagacgacgaccgacgacgacgaccgtatacgtactcgtcgaccaagaaactccggtaccacgtactagttacggactaccgtaggg

SEQ ID NO: 388595 - DNA, 601 bp, Homo sapiens
  misc_feature: GZ8MTXP02JLUL3.11.67.G01.1.454.CMB.2.raw
  modified_base (174)..(174): a, c, t, g, unknown or other
  modified_base (194)..(194): a, c, t, g, unknown or other
  modified_base (317)..(317): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctnagcgtctcgggacccccggnagagaatcaccatctcttgtactggaagcagctccaatatcggaagtaacgatgtcaattggtatcaacatctccccggtacggcccccaaactcctcatctataggaatagccagcgccctnacgggtcctcgcgctctctcgcgtctacgacgtcgcgacctctacgcctccctccgtcgtcgtcgacgtcgggcgtcctacgtcttcgaggagtgaggatcgaagttacttagttagtgtacgacgcgggtgggtaggtagtcgggtaccgttgaggtggtcgtggttggtcggttcggtcgggacgggggaccgaacgacggtcggtacccggtacccggtcgggttcggaccgaaccggaacccggtcggtcccgtccccggtccccgtcggacctttcccg

SEQ ID NO: 388596 - DNA, 535 bp, Homo sapiens
  misc_feature: GZ8MTXP02GR5RN.11.67.G01.1.454.CMB.2.raw
  modified_base (303)..(303): a, c, t, g, unknown or other
  modified_base (402)..(402): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtgtcgttttctaggtggctaattttaaaaggtgtccagtgtgaggtggagttattgcagtcgtggggggggcttggtgcagccggagggggtcctgagctctcctgtgtgctctggattcagttttagcagctacgcatgactggccncaggctccgaggggaggggctggagtgggtctcggtctataatggccccaggtgacaagacatactacgcagagtccgtgcgagggcccatgcacatcncagacacaactacacgacgacgactacgtactacacaacgagacgacgacgagagacgacgacgacgacgtacgtatactactacgtcgacgaacgaactaaccgtacgtacgtactagtcgtacgtacgtcg

SEQ ID NO: 388597 - DNA, 554 bp, Homo sapiens
  misc_feature: GZ8MTXP02FO752.11.67.G01.1.454.CMB.2.raw
  modified_base (311)..(311): a, c, t, g, unknown or other
  modified_base (314)..(314): a, c, t, g, unknown or other
  modified_base (357)..(357): a, c, t, g, unknown or other
  modified_base (373)..(373): a, c, t, g, unknown or other
tcagcgagagataccacgaccggtgctcgatttagagtatacatattgggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattacngtnccagaaactccgtcagatatgccactggtgcaatgctacgacncctatattatcaccanatggacgtcgtagggacgaaacgggacacggtcactcgtctcctcacgcctccaccgaacggcccatccgtccttcccccgtcggcccacccgtcctaccgaacgacgccaccgtccgtcgggggccaccgacgccggcccgtcgggcctcggtccgtcggtacgaacggtacttaacccg

SEQ ID NO: 388598 - DNA, 538 bp, Homo sapiens
  misc_feature: GZ8MTXP02HSPZ5.11.67.G01.1.454.CMB.2.raw
  modified_base (195)..(195): a, c, t, g, unknown or other
  modified_base (247)..(247): a, c, t, g, unknown or other
  modified_base (348)..(348): a, c, t, g, unknown or other
  modified_base (371)..(371): a, c, t, g, unknown or other
  modified_base (430)..(430): a, c, t, g, unknown or other
  modified_base (451)..(451): a, c, t, g, unknown or other
  modified_base (456)..(456): a, c, t, g, unknown or other
  modified_base (460)..(460): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctccaatatcggaaataacgntgtcaattggtatcaacatccgtccccggtacgaccccccaaactcctacatctataggaatagccagccgcccctcgacggggtccctgggccgtattcncgtggctacgagtctggcacctnacgcctcccgtggccctgcaggtcggctccgagtctggagctgagctgacttatattgngcgagcgtgggatggacggtntaggngtgngtggtgtcgtcgggcggacgacagcgtcggtaccgtcgcggccacgccgacggtccgtcccgcccgtcgtctcgtccg

SEQ ID NO: 388599 - DNA, 625 bp, Homo sapiens
  misc_feature: GZ8MTXP02HILMA.11.67.G01.1.454.CMB.2.raw
  modified_base (419)..(419): a, c, t, g, unknown or other
  modified_base (474)..(474): a, c, t, g, unknown or other
  modified_base (493)..(493): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggtcttaattttaaaaggtgtccagtgtgaggtggagttattgcagtcgtggggggggcttggtgcagccggagggggtccctgagactctcctgtgtaggctctggtattctagttttagcagctacgccatcgaccgtcgggtcccgccgacggcctaccgaggggaacggggcgtgggaggttcgggtcgtcggacttattaagtcggaccccgacgggtgacaagacatactacgcagacgtccgngcgagggccagtcgacaccatcctacccgagacgactaactcccagaacgaccgntacgtacctagactaaagnggacacgacctaggacgacggacccgaaccgaaccgaccgggtaccgttaattaacgtacgttacgtaccgaccaaacggtaaaacctcccggtaaccaaggtaacttaacggttcgaacccgtagtacggg

SEQ ID NO: 388600 - DNA, 713 bp, Homo sapiens
  misc_feature: GZ8MTXP02IXFGQ.11.67.G01.1.454.CMB.2.raw
  modified_base (195)..(195): a, c, t, g, unknown or other
  modified_base (222)..(222): a, c, t, g, unknown or other
  modified_base (250)..(250): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcggggacccccggnagagactcacatctcttgtactggaancagtctacaattagtacggaagtaacgntgtactaagttggtatacaactactccgtaccccggtaccgacccctaaactcctacactactaagtaaggaactacgaccacggccggtcccgtacggtacggggtcccgtcgggcctacgttcgtcgtcggctacgtaacgtcgtcggacctacctcgaccgtcccgtccgtcggcctcggaccgtacgggtcggcctccgtagtcgtaggaggtacgtacggacgtcgtacgtaacttagtttacgttggtacgtacggaggtcgggttaggggtacgttacgggtacgggttcgttaggtacggttcggtcggtttcgggttcgggttccgggttcgggggacgggtaacgggtaacgacggtccgtaccgggtacccggttccggtacgggtaccgaaccggtaacccgtaacggtcccgtaccccggtaccccgttacggttaccgtacccgttccg

SEQ ID NO: 388601 - DNA, 672 bp, Homo sapiens
  misc_feature: GZ8MTXP02IWPX8.11.67.G01.1.454.CMB.2.raw
  modified_base (209)..(209): a, c, t, g, unknown or other
  modified_base (213)..(213): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggaccccccggnaganatcacatctcttgtactggaagcagcctaccaatacgtacggaaagtaacgatgtactaagttgtactacaacactcccgtaccccggtacccgacccccaaacctcctactactactaataggaactacgaccgacggccggtccctccggaccggggtcccgtcggccccgtacttccgtcgtcggctacgtaacgtccgtcgacctacctcgaccgtccctcccgtcggcctcgcgtacggtcggtcctccgtacgtcgtaggacggtagtacggacggtctagtaactttagtttagttggtcgacgtaggtcggtagggtagtcgggtaccggttcgtggtaggttcggtcgttgggttcggttccggttaccggggaccggggaacgggtacccgtaacggtccgtaccggtacccggttccggtaccgggtaccgaccggacccggaaccgg

SEQ ID NO: 388602 - DNA, 581 bp, Homo sapiens
  misc_feature: GZ8MTXP02IXCP5.11.67.G01.1.454.CMB.2.raw
  modified_base (316)..(316): a, c, t, g, unknown or other
  modified_base (399)..(399): a, c, t, g, unknown or other
  modified_base (409)..(409): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagttttgggctgagcgtggtcgttttctaggtggctaattttaaaaggtgtccagtgtgaggtggagttattgcagtcgtggggggggcttggtgcaggccggagggggtccctgagactctcctgtgtaggctctggtattcagttttagcagctacgccatcgacctgggtccncaggctccgagggagggctgggagtgggtctcggctagttaagtggccccgacggtgacaagacatactcgcagacgttccgngcgacggcancgacacactcacgagacactaactaccgagaacgacgtctacgtacctagaactaagtacgaacgacgacgtagacggaccggaccgaacgaccgtaccggtacgttattaacgttacgtacgtacgaccgaagtaaccgtccgtacaagtactacgtcgtacgtacgtacg

SEQ ID NO: 388603 - DNA, 658 bp, Homo sapiens
  misc_feature: GZ8MTXP02GTXGH.11.67.G01.1.454.CMB.2.raw
  modified_base (324)..(324): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcaggtcggtggggggggcttgggtgcgagccggacgggggtccctgacgactctcctgtgtaggctcgtggtattcgtagttttagcagctacgccatcgaccgtgggtcccnccgaggcctccggaaggggaacggggcgtgggaggttcgggtcgtcggtacttaagttaaagtcggccccgacgggtcgacgaaacgacaacttaactaccggacaaggtaacgtcccgtgaccggacggggccccgaagtcggacccaacccactaccctaccgaagacgaacctaaaccttaccccgaaagaaacgaccgtccgtacgtacccgtgaaccaaagtcggaacgacgtccgagacgacgaccgtacgaaccgacgggtaccctaaattacgtacgtcgacgacccaagtaaacctccgacaagtactagttcgcgtacgtcggg

SEQ ID NO: 388604 - DNA, 444 bp, Homo sapiens
  misc_feature: GZ8MTXP02GGAVY.11.67.G01.1.454.CMB.2.raw
  modified_base (440)..(444): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtcagatattgcactggtggcaactgctacgacgcctactattatcaccacatggacgtctggggcaaagggaccacggtcatcgtctcctcagcctccaccaagggcccatcggtcttccccctggcccacccctcctccaagacgccacctctgggggcacagcgccctgggctgcctggtcaaggactacttccgtatctctcgctgagcgggctggcaaggcgcatagnnnnn

SEQ ID NO: 388605 - DNA, 687 bp, Homo sapiens
  misc_feature: GZ8MTXP02H9NIZ.11.67.G01.1.454.CMB.2.raw
  modified_base (209)..(209): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcacccctcctcactcactgtgcagggtcctgggcccagtctgttctgactcagcccacctcagcgtctcgggacccccggnagagaatcaccatctcttgtactggaagcagcctaccaatatcggaagtaacgatgtactaaattggtatacaacatcccgtcccccggtaccggacccccaaaactccctacactcctaataggaaatacgccagccggccctcgacggggtccctggccccgatttcctctggctcggaacgttcctgggccaacccgttcgacgtcccctccctcgggcccttgcgtaggtcgggcctcccgtagttccgtggaggagttcggaaggtccttaggtaacctttagtttaagttggttacgaccgtagggtccgggttaggggtaacgttcgggtaacgggttcgttaggggaacgtttcggtccggtttagggttcggtttccggttccgggggtacggggtacggggtaaccgaaacggtccgtacggtaaccccggtccggtacggggttacccaacggtaccccgaacgggg

SEQ ID NO: 388606 - DNA, 594 bp, Homo sapiens
  misc_feature: GZ8MTXP02GNV63.11.67.G01.1.454.CMB.2.raw
  modified_base (322)..(322): a, c, t, g, unknown or other
  modified_base (361)..(361): a, c, t, g, unknown or other
  modified_base (405)..(405): a, c, t, g, unknown or other
  modified_base (434)..(434): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcaggtcggtgggggggggcttgggtgcgaggccggagggggtccctggagacctctcctgtgtaggctctggattctagttttagcagctacgccatgaccgtgggtcccnccgaggcctccgaggggaggggctggagtgggtctcggntatagtggcccgacggtgacaagacatactcgcaggacgtccgngcgacggggccgagtcgccaccacttccncccaagacgacaacttaccccgagaacgacgctacggtacctgacaaacgtgaacagcctaggaacgacgaccgacgaccgaccgggtacctagtaacttacgtcgtcaccgaagtaaacctccggtaccaaggtacttaagttcgaccgtaacgtcggg

SEQ ID NO: 388607 - DNA, 650 bp, Homo sapiens
  misc_feature: GZ8MTXP02F9PYP.11.67.G01.1.454.CMB.2.raw
  modified_base (209)..(209): a, c, t, g, unknown or other
  modified_base (213)..(213): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccgggnaganaatccaccatctcttagtactggaagcagcctaccaatagtacggtaagtaacgatgtactaattggtatacaacactcccgtaccccggtaccgacccccaaacctcctacatactaagtaaggaatacgacccacgccggccctacgaccggggtcccctggccccgtactttccgtcgtcggtctacggaacgtcgtcggaccacctccgacgtccctcccgtcggtcctcgcgtaggtcgggtcctccgtacgtcgtaggaggtagtaggacggtctagtacttagtttagttgtcgcgtacggtcggtagggtagttacggacggttcgtggtaggtcgtcgttggttcgggttccgttcggggacgggtaacgggtaaccgaaggtccgtacggtacccggttcgtcgggtaccgaccggacccgtaacgg

SEQ ID NO: 388608 - DNA, 578 bp, Homo sapiens
  misc_feature: GZ8MTXP02HZZQC.11.67.G01.1.454.CMB.2.raw
  modified_base (193)..(193): a, c, t, g, unknown or other
  modified_base (406)..(406): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctaccaattatcggaagtaacgatgtcaattggtatcaacatcctccccggtacgcccccaaactcctcatctataggaatagccagccggcctcgaggggtccctggccgtattcctctggctcgaacgtctggcacctcacgccctccctggcctgccagtcgggctccgagtctggagntggaggtctagacttattagttgtgacgaggtcggtagggtatggacgggtctaggacgtgtcgttggttcggttcgttcgggcgggtacgggaccaaggtccgtacggacccgttccgtcggggtacacggcccgaaggcccgtcccggccccgtcggtcctacgttcccg

SEQ ID NO: 388609 - DNA, 736 bp, Homo sapiens
  misc_feature: GZ8MTXP02GQRJ7.11.67.G01.1.454.CMB.2.raw
  modified_base (312)..(312): a, c, t, g, unknown or other
  modified_base (350)..(350): a, c, t, g, unknown or other
tcagcgagagataccacgaccggtgctcgatttagagtatacatattgggtttggggagctctgagagaggagcccagccctgggattttcaggttgttttcatttggtgatcaggactgaacagagagagctcaccatggagtttgggctgagcgtgtcgttttctaggtggctaattttaaaaggtgtccagtgtgaggtggagttattgcagtcgtggggggggcttggtgcgagccggaggggtcctgagactctcctgtgtaggctctggtattctagtttagcagctacgccatcgacgtgggccncgaggctccgagggaggggcgtggaggtgggtctcggntataaacgtcggtaccccgacgggtcgacaaaggacattaacctacggacacggtaacggtccccggtggacgacgggggacccaagtcggacccaaacccgaaacttccctaacccgaaagtaacgggtaaacccaaactttacccccgaaaaggaaaaccgaaaccgggccttaacgggttacccccttaggaaacctaaaaggtacggggaaaccctaaacggtcccgtaggaaccggggaacgaccccggtaaaccggaaaccggacccgggttaccccggttaaagttaaccctttagtaacggttccggtaaccccaaagtaaaaccggtaacccttaacccggaacgtaaaactgtttacggcctaacggtttacgggg

SEQ ID NO: 388610 - DNA, 561 bp, Homo sapiens
  misc_feature: GZ8MTXP02F50S9.11.67.G01.1.454.CMB.2.raw
  modified_base (193)..(193): a, c, t, g, unknown or other
  modified_base (265)..(265): a, c, t, g, unknown or other
  modified_base (293)..(293): a, c, t, g, unknown or other
  modified_base (465)..(465): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctaccaatatcggaaagtaacgatgtcaattggtatcaacntcctccccggtacgcccccaaactcctnatctataggaatagccagccgccctcgacggggtccctggccctatttcctcgtggcctcgaacgtctggaccacctcgacgccctcccgtggccctgccgaggtcgggcctccgagtctggagatggagctgacttagttattcgtgcgtagtcggtgggatggaccggtntgagtgtcgtgtggtcgttcgggcggacggaccagcgtacggaccgtcgtcgggtcacgaacccgaggccgtccggcccccgtcggtccacttccg

SEQ ID NO: 388611 - DNA, 603 bp, Homo sapiens
  misc_feature: GZ8MTXP02IE9WH.11.67.G01.1.454.CMB.2.raw
  modified_base (174)..(174): a, c, t, g, unknown or other
  modified_base (194)..(194): a, c, t, g, unknown or other
  modified_base (374)..(374): a, c, t, g, unknown or other
  modified_base (412)..(412): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctnagcgtctcgggacccccggnagagaatcaccatctcttgtactggaagcagcctaccaatagtcggaaagtaacgatgtacaattggtatcaacatccgtaccccggtaccgacccccaaactcctcatctagtaggaatagccagccggccctcgacggggtcccctggcctattctcgtgctcgaacgtctgcacctnacgcctcccgtggcctgcaggtcggccttccgagttcnggacgatggaggctagacttattagttgtcgcgtaggtcggtggggtatggtacggttctaggtagtgtcgttggttcggttcgttcggggacgggacgggaccaggtcgttacggacccggttcgtcggggttccaacggtaacccgaaggtccctacccggtcccccgtttcggtacctaccgttcccg

SEQ ID NO: 388612 - DNA, 606 bp, Homo sapiens
  misc_feature: GZ8MTXP02I6RIH.11.67.G01.1.454.CMB.2.raw
  modified_base (280)..(280): a, c, t, g, unknown or other
  modified_base (312)..(312): a, c, t, g, unknown or other
  modified_base (531)..(531): a, c, t, g, unknown or other
tcagcgagagataccacgaccggtgctcgatttagagtatacatattgggtttggggggaagaggaagactgacggtccccccaggagttcaggtgctgggcacggtgggcatgtgtgagttttgtcacaagatttgggctcaactctcttgtccaccttggtgcagccgagggggtccctgagactctcctgtgtaggctctggattcagttttagcagctacgccatgacctgggtccgcaggctccgagggagggctggagtgggtctcggctatanggccaggtgcaagacatacacgcagagtccgngcaggccgatcgccacatcctaccagacgacaacctacccagaacgacgctacgtacctgacaaagtcggaacagacctagagacgaccgtaacgacgacgggtacctatacttacgtgtacgaccaaagtaactcccgtaccaagtaacttacgttacgacctaacgtcgggtacgacctaacgtcgaccgttaacgaccgtaccctaattacttacnccaaacccagtacgtacggtaccgtacggtaacgggggaacaaaacggggacctacggtacaacgttacccgtcc

SEQ ID NO: 388613 - DNA, 616 bp, Homo sapiens
  misc_feature: GZ8MTXP02GJK6L.11.67.G01.1.454.CMB.2.raw
  modified_base (194)..(194): a, c, t, g, unknown or other
  modified_base (263)..(263): a, c, t, g, unknown or other
  modified_base (373)..(373): a, c, t, g, unknown or other
  modified_base (450)..(450): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaagcagctccaatatcggaataacgatgtacaattggtatcaanatcctccccggtacgcccccaaactcctcatctataggaatagccagccgcctcgaggggtccctggccgattctcgtggctcgaacgtctcggcacctcacgcctccgnggcctgccgagtcgggcctccagtctggagatgaggctgacttattatgtgcgagtcggtagggatcggtacggtcnggtagtggtcgttggttcggtacgtttcgggggccggaacgggtacccgaaaggtccgttacggtaaccccggttccggtacgggggtaccctaccgggaaccccgtaaacggggtcccgttaccccggtaccccccgtttacggggtccctaccggtttccccgg

SEQ ID NO: 388614 - DNA, 585 bp, Homo sapiens
  misc_feature: GZ8MTXP02F9EFH.11.67.G01.1.454.CMB.2.raw
  modified_base (196)..(196): a, c, t, g, unknown or other
  modified_base (224)..(224): a, c, t, g, unknown or other
  modified_base (245)..(245): a, c, t, g, unknown or other
  modified_base (419)..(419): a, c, t, g, unknown or other
  modified_base (575)..(575): a, c, t, g, unknown or other
tcagcgagagataccacgaccggtgctcgatttagagtatacatattggggtttggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaancagctcaatatcggaatacgntgtcaattggtatcaacatcctccccggtacgcccccaaactcctcatctataggaatagccagccggccctcgacggggtcccctgggcccgatttcctcgtggctcgaacgtcgtggcacctcacgccctcccgtggcctgcaggtcgggcctcgagtcgtggaggatgagntgtacttattagttgtgcgagtcggtagggagtggtacggtcgtggaggtgtcgttggttgggtcgttcggggcgggtacggggaccgaaggcgtacggacccggttccgtcggggtccacggcccgaacggccgtcccgcccccgtcggtacccnccgtttcccg

SEQ ID NO: 388615 - DNA, 644 bp, Homo sapiens
  misc_feature: GZ8MTXP02JBDPP.11.67.G01.1.454.CMB.2.raw
  modified_base (317)..(317): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtcagtgtgaggtggagttattgcagtcggtggggggggcttggtgcgagccggagggggtccctgagactctcctgtgtaggctcgtggtattctagttttagcagctacgccagtcgaccgtgggtcccnccgaggctccgaggggaggggcgtgggaggtgggtcgtcggacttagttaagtcggccccgtacgggtgacaagacaattacgcgcaggtacgtccgtgacgacggggccgagtcgaccaccacgtcctaccgaagacgaactaaccttacccgaagaacgaccgtctacgtacccgtgactaaaagtcggaacacgaccgtaggaacgacgacccggaacgaaccgaccgggtaccgttaattaacgttaacgttcggaccgtaaccgaaagtaaaccgtaacccgtacccaaggtaacttacgtacgtaccgtacgtttacgggg

SEQ ID NO: 388616 - DNA, 440 bp, Homo sapiens
  misc_feature: GZ8MTXP02FE6KD.11.67.G01.1.454.CMB.2.raw
  modified_base (324)..(324): a, c, t, g, unknown or other
  modified_base (436)..(440): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggnttccccctggccaccctcctccaagagcacctctgggggcacagcgccctgggctgccctggtcaaaggctacttccgatctctcgctgagcgggctggcaaggcgcatagnnnnn

SEQ ID NO: 388617 - DNA, 633 bp, Homo sapiens
  misc_feature: GZ8MTXP02F6UKF.11.67.G01.1.454.CMB.2.raw
  modified_base (198)..(198): a, c, t, g, unknown or other
  modified_base (349)..(349): a, c, t, g, unknown or other
  modified_base (373)..(373): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctcagcgtctcggggacccccgggnagagaatcaccatctcttgtactggaagcagctaccaatatcggaaagtaacgatgtctaattggtatcaacactcctaccccggtacgcccccaaatcctacatctaataggaatacgccagcggccctcgagggtcctcgcgactctcngcgtcacgtactcgtcgcctcacnctccctcgcgtcgtcgacgtcggtcgcctacgacgttcgaggaagtcgtaggaccgtgtacttaatttagttgttgacggacgtacgggtggggttaggacggtagggtccggttgtagggtgttcggtgtttcggggtcggtttcgggccgggggacgggtacggaaacggtcggcgttaccgggtccgttcggggtaccggacgaacccggacggtaccggtccccgtccccggttacccgtaccgtacgtttccccg

SEQ ID NO: 388618 - DNA, 583 bp, Homo sapiens
  misc_feature: GZ8MTXP02FFV2M.11.67.G01.1.454.CMB.2.raw
  modified_base (339)..(339): a, c, t, g, unknown or other
  modified_base (357)..(357): a, c, t, g, unknown or other
  modified_base (367)..(367): a, c, t, g, unknown or other
  modified_base (413)..(413): a, c, t, g, unknown or other
tcagcgagagataccacgaccggtgctcgatttagagtatacatattgggtttggggttgagaagacaggactcaggacaatctccagcatggccagcttccctctcctcctcaccctcctcactcactgtgcagggtcctgggcccagtctgttctgactcagccaccctcagcgtctgggacccccggcagagaatcaccatctcttgtactggaagcagctccaaatatcggaagtaacgatgtcaattggtatcaacatctccccggtacggcccccaaaactcctcatctataggaatagccagcggccctcagggtcctcgcggacgtactcngtcgtcgacgtacttcgngacctctacncgtcccctcgcgtcgtcgacgtgggcgcctacgcgttgagggaagngtaggacgtcgtacgtaattaattagttgccgagacggtcgggtaggtagtacggggtaccgttcgtaaggtggtcgtcgttgggtcggtttcggtcgggacggggacgaacgaacgtcgaaccggtccgtcggtcgacgcccgaacgcgtcgcccgtccgtcgctaccg

SEQ ID NO: 388619 - DNA, 549 bp, Homo sapiens
  misc_feature: GZ8MTXP02JKF7O.11.67.G01.1.454.CMB.2.raw
  modified_base (207)..(207): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctccaatatcggaagtacgatgtcaattgatcaacatcctccccggtacgccccaaactcctcatctataggaatgccagcgccctcgacgggtccctggccccgattcctctggctacgaagtcgtcggctacctcacgccctccctggccctgcagtcgggctccgagtctggaggactggagctagacttattagtcgtgcaggtcgtagggactggacggtctgagtcgtcgtggtcgggttcgtacggggcggtacgggaccaaggtccgtcggtacccggtcgtgggtaccaccggccgaacggg

SEQ ID NO: 388620 - DNA, 739 bp, Homo sapiens
  misc_feature: GZ8MTXP02JXPVP.11.67.G01.1.454.CMB.2.raw
  modified_base (210)..(210): a, c, t, g, unknown or other
  modified_base (214)..(214): a, c, t, g, unknown or other
  modified_base (221)..(221): a, c, t, g, unknown or other
  modified_base (231)..(231): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagcgtcgtcgggacccccggnaganactcacntctcttgtanggagcacgcctacaatacgtacggaagtaacgatgtactaagttgtactacaactactcccgtaccccggtacccgacccctaactcctactactactaagtaagaactacgcccgacggccggtacccgtacggtaccggggtcccgtcggccccgtacttccgtcgtcggtccgtacggtaacgtccgtcggacctaccgtccgaccgtccccgtcccgtcggtcccgtacggcgtacgggtccggtccctaccgtacggtccgtaggaaggtacgtacggtacggtacgttacgtaaactttagtttacgttgggtacggtacggtacgggttcggggttagggtacggttcgggtaccgggtttgtacgggtaggttcgggtcggttcggggttaccgggttccggggttaccgggggaccgggggtaacggtaacccgtacgggtccggttacccggttcccggttacggggtaccgggtaccgtaccgggtacccgtacggg

SEQ ID NO: 388621 - DNA, 802 bp, Homo sapiens
  misc_feature: GZ8MTXP02JT6M0.11.67.G01.1.454.CMB.2.raw
  modified_base (313)..(313): a, c, t, g, unknown or other
tcagcgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccatgcaccatctccagagacaattcccagaacgacgctgtacctgcaaatggacagcctggagagccgacgacacgggcctatattacngtcgccaagaaactcccgtacaagtactattcgccctacgttgggtcggaccaaacgtgaccgtaccgaccgtacccttaacttaatttacacccaaacccactaacgtacgggtaccgttccggtacgggggaaccgtaaaacgggggaccccgtaacggggtaccgtaacgttcccggttacccgttaccccttaccgaccggtacccccttaacccccgaaccccggaaaccccgggggtaccccctaaaccggttcccccggggtttacccccgtttaccccccccggttccgggtacccccgtaccccccttacccccgttaccccgaaaacccggacccggtacccgtaaccccgtcccgggttacccggggggaaccctaacccgggaccggaccccggggtaccccggtccgggggtcccgttcccgggtaccccggttccgggtaacccggtaaacccgggtaacccgtttaacccccgg

SEQ ID NO: 388622 - DNA, 598 bp, Homo sapiens
  misc_feature: GZ8MTXP02HB988.11.67.G01.1.454.CMB.2.raw
  modified_base (527)..(527): a, c, t, g, unknown or other
tcagcgagagataccacgaccggtgctcgatttagagtatacatattgggtttgggggaagaggaagactgacggtccccccaggagttcaggtgctgggcacgggtgggcatgtgtgtagttttgtcacaagatttgggctcaactctcttgtccaccttggtgcagccgagggggtccctgagactctcctgtgtaggctctggattctagttttagcagctacgccatgacctgggtccgcaggctccgaggggaagggctggaggtgggtctcggctattaatggccgacgggtgcaagacatactacgcagacgtccgtgcgaggccgatgacaccatctaccagagacaacttcccagaagacgctagtacctgacaaaatcggacagcctagagacgccgaacgacgacggaccgtatattactgtcgaccagaactccgtacaagacttatcgactacgtggtacgacaaacgtgaccttacgacgtaccctaacttacttaactaccaacctaaaccngtacggtacgttacggtaacggggaaccgaaaacggggacccgtaacgggtacctaagtacccgttacccg

SEQ ID NO: 388623 - DNA, 499 bp, Homo sapiens
  misc_feature: GZ8MTXP02G5RUT.11.67.G01.1.454.CMB.2.raw
  modified_base (192)..(192): a, c, t, g, unknown or other
  modified_base (457)..(457): a, c, t, g, unknown or other
tcagcgagagataccacgaccggtgctcgatttagagtatacatattgggtttggggttgagaagacaggactcaggacaatctccagcatggccagcttccctctcctcctcaccctcctcactcactgtgcagggtcctgggcccagtctgttctgactcagccaccctcagcgtctggggacccccggnagagaatcaccatctcttgtactggaagcagctccaatatcggaataacgatgtcaattggtatcaacatctccccggtacggcccccaaactcctcatctaataggaatagccagcggcctcaggggtcccctggccgattctctggctcgaagtctggcacctcagcctccctggcctgcagtggctccagtctgagatgagctgactatatgtgcagcgtgggatgacgggtctgagtgctgtggtctggcgaggacaagcngaccgtctcgggtcacgccgaacgctcgcccctcggcactcg

SEQ ID NO: 388624 - DNA, 599 bp, Homo sapiens
  misc_feature: GZ8MTXP02IIDY3.11.67.G01.1.454.CMB.2.raw
  modified_base (376)..(376): a, c, t, g, unknown or other
  modified_base (393)..(393): a, c, t, g, unknown or other
  modified_base (550)..(550): a, c, t, g, unknown or other
tcagcgagagataccacgaccggtgctcgatttagagtatacatattgggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccaagaagacgctgtacctgcaaatggacagcctgagacgccgacgacacggccgtatatactgtagccagaaactccgtcaagactattgccactggtcgcaactgactacgacgctactattacncacacatggacgttcgnggggacaaacgggaccacggtcattcgtactcctacacgccctaccgacccgaacgccccgaatcccggtcctttcccccgtggcccctaaccccgtcctacccgaaacgtacgacctacctcggtacgggggcccacgaaccggcccggtacccgngggcccgttacggcccgttcgggtaccgtaaacgggtacctttaacccg

SEQ ID NO: 388625 - DNA, 597 bp, Homo sapiens
  misc_feature: GZ8MTXP02JNMN1.11.67.G01.1.454.CMB.2.raw
  modified_base (415)..(415): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcagtcggtggggggggcttgggtgcgaggccggagggggtccctgagactctccgtgtgtaggctcgtggattcagttttagcagctacgccagtcgaccgtgggtcccgcgaggcctccgaggggacgggcgtggagtgggtctcgggctagttaagtggaccccacgggtgacaagacagtactcgcagacgtccgtgacgngggcccagtcgaccaccgactcctacccgaagacgaactaacttcccgaagaacgacgctagtaccctagacaaagtggaacacgccgaggacgacgacccgaacgaccgacggtacgtataactacgtcgtacgaccgtaagaaaccgtccggtaccaagtactcgttacgctaacgtggg

SEQ ID NO: 388626 - DNA, 732 bp, Homo sapiens
  misc_feature: GZ8MTXP02GU4AT.11.67.G01.1.454.CMB.2.raw
  modified_base (189)..(189): a, c, t, g, unknown or other
  modified_base (211)..(211): a, c, t, g, unknown or other
  modified_base (215)..(215): a, c, t, g, unknown or other
  modified_base (241)..(241): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctnagcgtcgtcggggacccccggnaganactcactatctcttgtacgtaggacncagcctacaatacgtacggaaagtaacgatagtactaagttggtactacaactaccgtccccgtaccccggtacccgaccccctaactcctactattactaagtaacggaactacgaccgacggcccggtccccgtacggtaccggggtccctcggtccccgtacttccgtcgtcggtacgtacggtacgtccgtcgacctacccgtcgaccgtccccgtccggtcgggtccctcgaccggtacgggtccgggtaccctaccgtacggttcggtagggtacggtagtcgggtacggttacgttagttaactttagtttagtcgggtacggacggtacgggtacgggtaggggtacgtacggggtacggttagtagggtacggttcggtcggtttcggggttcgggttccgggtacgggggaccgggtaacggaccgtacggtccggtaccgggtaccggttcggaccggtaccgaccggtacccggtacgg

SEQ ID NO: 388627 - DNA, 598 bp, Homo sapiens
  misc_feature: GZ8MTXP02HAE5M.11.67.G01.1.454.CMB.2.raw
  modified_base (312)..(312): a, c, t, g, unknown or other
  modified_base (406)..(406): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtcagtgtgaggtggagttattgcagtcgtgggggggcttggtgcgagccggagggggtccctgagactctcctgtgtaggctctggtattctagttttagcagctacgccatcgaccgttgggccnccgaggcctccgaggggtagggcgtggagtgggtctcggtactattaagtcggcccgacggtggacaagacataccgtacgcaagacgttccgngcgagggggcccaagtgacccaccaatcctaccgagacgactaaacgttcccaaagaacacgcttacggaccctggaactaaagacggacagaccgtaggaacgacgacccgaaccgacgtaccgggtacctattaacgttactagacgacccaaggtaaacttcccggactatactagttcgactacgtgg

SEQ ID NO: 388628 - DNA, 468 bp, Homo sapiens
  misc_feature: GZ8MTXP02IRMZL.11.67.G01.1.454.CMB.2.raw
  modified_base (453)..(453): a, c, t, g, unknown or other
  modified_base (456)..(468): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaaatggacagcctgagagccgacgacacggccgtatattactgtgccagaaatccgtccagatattgcactgggtggcaactgctacgacgcctactattatcaccacatggacgtctggggcaaagggaccacggtcatcgtctcctcacgcctccaccaacggcccatccggtccttccccctcggccccaccctcctcccaagacgccacctcgtgggggcacgacgccggcccgtgggctcgcctggtcaaggactacttccgtactctctcgctgagcggctcggcaaggcgcanagnnnnnnnnnnnnn

SEQ ID NO: 388629 - DNA, 621 bp, Homo sapiens
  misc_feature: GZ8MTXP02IOHHQ.11.67.G01.1.454.CMB.2.raw
  modified_base (175)..(175): a, c, t, g, unknown or other
  modified_base (196)..(196): a, c, t, g, unknown or other
  modified_base (307)..(307): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagcccaccctnagcgtctcggggacccccggnagagaatcaccatctcttgtactggaagcagctaccaatagtcggaagtaacgatgtacaattggtatcaacatccgtccccggtaccgccccccaaactcctcactctanaggaatacgccagccggcccctcgacggggtcccctgggccgtattctctggctacgagtcgtggacacctcgacgtccctcccgtgccctagccgtaggtcgggcctccgagtcgtggagatgagtctgtacttattagtgtagcacggtggtggggtatgggtacggtcgtggtagtcggtcgttgggttcggttacgggtcggggtaccggggacgggaccgaacgggtcgtacggtacccgggtccgttcggggtccgaccggtaaccgaacggccctccggtacccccgtcggttcccaccgtttcccg

SEQ ID NO: 388630 - DNA, 891 bp, Homo sapiens
  misc_feature: GZ8MTXP02IBRRE.11.67.G01.1.454.CMB.2.raw
  modified_base (209)..(209): a, c, t, g, unknown or other
  modified_base (237)..(237): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaccatctcttgtactggaancagcctaccaaatagtacggaaagtaacgatgtactaaattggtatacaacctactcccgtacccccggtaacccggaccccctaaaaccgttcccctacaacttacctaaagtaaggaaaactacggacccaaggtcccgggcccctacggtaaccgggggttcccctcgggaccccccgtactttccgtccgttcggggaccttaccgggtaaacggtttccgtacgggtcccaaacccccgtttccgtaccggtcccccgttcccgttcgggcccccttggccgtacgggtcggggacccttccgtaggttaccgtggtaacggtagttcgggaaacgggtccgtttaggtaaaccttttaaggtttttagtttgggtacggtaaccgtaggggtacccggggtttaggggtaacgtttcggggtaaacccggggtttcgttaaaggggtaccgggtttcgggtacccggttttgggggtttacggggtttttcccccggggttaccggggggaacccgggggttaaaaccgggggtaaaccccgtaaaacgggggtttcccccgtaaacccggggttaacccccgggtttccgggggttaccgggggtttaacccccgaaaccggtttaacccccggggaaacccggggg

SEQ ID NO: 388631 - DNA, 521 bp, Homo sapiens
  misc_feature: GZ8MTXP02IK3Z6.11.67.G01.1.454.CMB.2.raw
  modified_base (174)..(174): a, c, t, g, unknown or other
  modified_base (193)..(193): a, c, t, g, unknown or other
  modified_base (221)..(221): a, c, t, g, unknown or other
  modified_base (243)..(243): a, c, t, g, unknown or other
  modified_base (488)..(488): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctnagcgtctgggacccccggnagagaatcaccatctcttgtactggaancagctcaatatcggaataacgntgtacaattggtatcaacatcctccccggtacgaccccaaactcctcatctataggaatgccagccggccctgacggggtccctggccgtattctcgtggctcgaagtcgtgcacctcacgcctccgtgcctgcaggtcggcctccagtctgagatgagctgtactattatgtgcgagtcggtggggactggtacggtcgtggagtgcgtggtggtcgtcgggcggacggacagcgtcgcgtcgnggtcagtccgagcctcgcccgtcggtcactccg

SEQ ID NO: 388632 - DNA, 733 bp, Homo sapiens
  misc_feature: GZ8MTXP02H5F1R.11.67.G01.1.454.CMB.2.raw
  modified_base (288)..(288): a, c, t, g, unknown or other
  modified_base (325)..(325): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagttttgggctgagctggtcttttttcttgtggcttaattttaaaaggtgtccagtgtgaggtggagttattgcaggtcggtggggggggctttgggtgcgaggccggacgggggtccctggagactctcctgtgtaggctcgtggtnttcagttttagcagctacgcatcgaccgtgggtcccnccgacggcctccggaaggggaagggcgtagggagggtcggggtctacgggaccttaagttaacgtcggcccccgacggggtcggaccaaagacgtaaacgtaccgtaccgacgaacgtaacggttcccggtagaccggacggggacccgatcgacccaaccactcctacccgaagtaacgacctaaacgtaccccgagaaaccgccgtacgttacgtaaccgttacgaacgaaagtaccgggaacaacggtccgtaaggaacggaccggacccgaaaccgaaaccggtaccggtaaccgttaacgtaaccttaacggtacggttaccgaacccgtaaaacggtaaacccgttaacccggttaaaccgaaacggttacgttaacgtacggtaaccgtacggttacgggg

SEQ ID NO: 388633 - DNA, 642 bp, Homo sapiens
  misc_feature: GZ8MTXP02HRY5C.11.67.G01.1.454.CMB.2.raw
  modified_base (193)..(193): a, c, t, g, unknown or other
  modified_base (197)..(197): a, c, t, g, unknown or other
  modified_base (222)..(222): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccggnaganactcactatctcttgtagtaggacncagcctacaatacgacggaagtacatgtactaagttgactacaactctcccgtaccccggtaccgacccctaactcctacactactaagtaagaactacgccgacggccgtcccgtcggaccgggtccacgacgtcttcgcgtcgctacgtacgtcgcgccactcgccgtcctccgtcgtctcgacgtaggtcggtacctcgtagtcgtaggacgtacgacggtagtcgttacgtactttagttcgtgacgacgtacgggtgggtaggtagtcggtacggtcgtaggtgtcggtcgttgggttacgggttcgggtacggggacgggtacggtaaccacggtccgtacggttacccggtcgggtacggaccgaccgaaccggtacgtcccgtcccggtacccgtcgtaccgtccgttaccg

SEQ ID NO: 388634 - DNA, 798 bp, Homo sapiens
  misc_feature: GZ8MTXP02HCMMB.11.67.G01.1.454.CMB.2.raw
  modified_base (175)..(175): a, c, t, g, unknown or other
  modified_base (196)..(196): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccacctnagcgtcgtcggggaccccggnagagactcactatctcgttagtacgtaggaacgcacgtcctacaaagtacgtacggaaagtaacgtatgtactaagttagtatacaactactcccgtaccccggaccgacccctaactcctactactactaagtaaggaactacgaccgacggcccggtcccgtacgggtaccggggtcccgtcgggtaccgttacgttccgtcgtcggtacgttacggaaccgttccgtaccgaccctaccgtccgaccgttccccgttcccggtcggtccgtacggaccgtacggggtccggtcctaccgtacgtcgtaggtacggtacggtacgggtacgtacgttacgttaacgtttagtttagttcggtcgtacggtacgggtcgggttagggtagtacgggttacgggtgtacggtacggttcggttcggttcgggttcgggttaccgggtacggggtacggggtaacgggtaaccgtacggtaccggtaccgggtacccgggttaccgggtaccggggtaaccggtaacccgggtaacccggtaaccggttccccggtaccccgggtacccccggtttaccggtacccgtttacccggttccccg

SEQ ID NO: 388635 - DNA, 672 bp, Homo sapiens
  misc_feature: GZ8MTXP02HXDUE.11.67.G01.1.454.CMB.2.raw
  modified_base (175)..(175): a, c, t, g, unknown or other
  modified_base (196)..(196): a, c, t, g, unknown or other
  modified_base (251)..(251): a, c, t, g, unknown or other
  modified_base (362)..(362): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctnagcgtctcggggacccccggnagagaactcaccatctcttgtactggaagcagctaccaatagtcggaagtaacgntgtacaattggatcaacatccgtaccccggtaccggaccccctaaactccctacactctaagtaggaatacgccaggccggcccctgacggggtccctgggccgtatttcncgtggctacgagtctgcacctcacgcctccgtggccctgaccgtagggtcggccttacccgagtcgtaggaggtagtcgggaaggtctacggtaactttaagtttagtttggtacgacgtagggtaccggttgggggtaattcgggtaacgggttccgttaggaggttcggtcgttcgggtttacgggtccgtttcgggggacggggtaacgggacccgtaaaggccgttacgggtacccgtcgggtacgggtccacggaacccgtaagggtcccgtccgtcccccggtacggtacctaccgtttccccg

SEQ ID NO: 388636 - DNA, 506 bp, Homo sapiens
  misc_feature: GZ8MTXP02H5CZ9.11.67.G01.1.454.CMB.2.raw
  modified_base (282)..(282): a, c, t, g, unknown or other
  modified_base (487)..(487): a, c, t, g, unknown or other
  modified_base (491)..(506): a, c, t, g, unknown or other
tcagcgagagataccacgaccggtgctcgatttagagtatacatattgggtttggggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcacgcctccctggcctgcagtggctcagtctgagatgaggctgactattntgtgcagcgtgggatgacggtctgagtgcgtggtggtcgtttcgggcggtaacggggaccaaggctcgggaccccgttctcggggtcacggtaccccgaagggtccgtccggccccccgttccgggtccaccctttccgtcgtttcccccggcccccttctcgtactccttctcgactggacgtcgggctcgggcgagccggtanagtnnnnnnnnnnnnnnnn

SEQ ID NO: 388637 - DNA, 566 bp, Homo sapiens
  misc_feature: GZ8MTXP02JRDCW.11.67.G01.1.454.CMB.2.raw
  modified_base (239)..(239): a, c, t, g, unknown or other
  modified_base (418)..(418): a, c, t, g, unknown or other
  modified_base (468)..(468): a, c, t, g, unknown or other
  modified_base (493)..(493): a, c, t, g, unknown or other
tcagcgagagataccacgaccggtgctcgatttagagtatacatattgggtttgggggaagaggaagactgacggtcccccaggagttcaggtgctgggcacggtgggcatgtgtgagttttgtcacaagatttgggctcaactctcttgtccaccttggtgcagccgagggggtccctgagactctcctgtgtaggctctggattcagttttagcagctacgccatgacctgggtccncaggctccagggaagggctggagtggggtctcggctattaatggccacgggtggcaagacatactacgcagagtccgtgcagggccatgcaccatctccagagacaacttcccagaagacgctgtacctgacaaaatcggacagcctagacgagaccgacgacacggccgtatattacngtcgacagaaactccgtaccagactattgcaacgtggtggaccaaacgtnacgtacgaccgcctaactatttacnccaacctacacgtacggaccgtacggtcgggggaaccgaaaacggggacctacgggtactacgtcgttacccg

SEQ ID NO: 388638 - DNA, 642 bp, Homo sapiens
  misc_feature: GZ8MTXP02GK8WO.11.67.G01.1.454.CMB.2.raw
  modified_base (276)..(276): a, c, t, g, unknown or other
  modified_base (314)..(314): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtccagtgtgaggtggagttattgcagtcggtggggggggcttggtgcgagccggagggggtccctgagactctcctgtgtaggctctggnttctagtttagcagctacgccatcgaccgtgggtcccncgaggcctccgaaggggagggctgggaggtggggtacctcggctaagttaacgtcggccccgagggtgacaagacatactcgcaggacgtccgtgcgacggggccgatcgaccaccgatctcccgaagcgaactaactacccaagaaacgcgctacgtacctagacaaaagtcggaacctagccgtaggaaacgccggacccggaacggtacccgaaccgggtacccggttaaattaaacgtttaacgtcggttaccggaaccgtaaaacgtaaaacccgttcccggtaccctaaggtaacttaagtttcgacgtaccgttacggggg

SEQ ID NO: 388639 - DNA, 619 bp, Homo sapiens
  misc_feature: GZ8MTXP02H7IMT.11.67.G01.1.454.CMB.2.raw
  modified_base (195)..(195): a, c, t, g, unknown or other
  modified_base (218)..(218): a, c, t, g, unknown or other
  modified_base (223)..(223): a, c, t, g, unknown or other
  modified_base (337)..(337): a, c, t, g, unknown or other
tcagcgagagataccacgaccggtgctcgatttagagtatacatattgggtttggggggttgagaagacaggactcaggacaatctccagcatggccagcttccctctcctcctcacccctcctcactcactgtgcagggtcctgggcccagtctgttctgactcagccaccctcagcgtctcgggacccccggnagagaatcaccatctcttgtacnggaancagctcaatatcggaagtaacgatgtacaattggtatcaacatcctccccggtacggcccccaaactcctcatctaataggaatagccagccggcccctgacgggggttccccncggccgtattcctcgtggcctacgaacgtctcggcctacctcgaccgtcccctccgtcggtcccgtggaccgtaggtcgggtccgtccgtacgtcgtcggtaggtagtaggaggtacgtagtaacttaatttagttgtgacgacggtcggtggtagtgtacgggtacgtagtagtcgtggttggttcggttcggtcgggacggacggacgacgtcgtccggtaccggtccggtcgtacgaccgaaccgacgtccgtcccgtcccgtccgtacctaccgtccg

SEQ ID NO: 388640 - DNA, 721 bp, Homo sapiens
  misc_feature: GZ8MTXP02GX800.11.67.G01.1.454.CMB.2.raw
  modified_base (207)..(207): a, c, t, g, unknown or other
  modified_base (211)..(211): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnaganactcacatctcttgtactggaacgcagtcctacaatagtacggaagtaacgatgtactaagttggtatacaactactccgtaccccggtaaccgaccccctaaactcctactactactaagtacggaactacgcccgacggcccgtcccgtacggaccggggtcccgtcggccccgtacttccgtcgtcggtccgtacgtaacgtccgtcgacctacccgtccgaccgtccccgtcccgtcgggtcccgtcggtaccggtacgggtcggggtcccttacccgtacggttccggtacgggtaacgggtacgtacgggtacggtcgttacgtaactttaacgtttagttggtacggacgtacgggtcgggttaggggtagtacggggtacggttacgtagggtacggttcggtcggttgggttcgggttccggttacggggacgggtaacggaaccgtacggtccgtaccggtacccggttccgggtacggtaccgaccgggacccgtacgg

SEQ ID NO: 388641 - DNA, 638 bp, Homo sapiens
  misc_feature: GZ8MTXP02GGWP8.11.67.G01.1.454.CMB.2.raw
  modified_base (194)..(194): a, c, t, g, unknown or other
  modified_base (321)..(321): a, c, t, g, unknown or other
  modified_base (396)..(396): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctaccaaatatacggaaagtaaacgatgtactaagttaggtatacaaacactcccgtacccccggtaccggaccccccaaactcctacatactaanaaggaatacgccagccggccctgacggggtcccctgggccgtacttctcgtggctacgaacgtctgcacctcacnccctccgtgcctgcgagtgggcctccagtctaggaggatggacggtctagtaacttaatttagttgtcggcgacggcggtagggtaggtacggtacgggttacgttcggtaggtggtcgtcggttgggttcggtttcggggtcgggggacggggaaccggaacgacgtacggtaccggtcccgtcggtacggaccgaacccgaaccggaccgtccggtcccccgtcccggtccgtacctccg

SEQ ID NO: 388642 - DNA, 714 bp, Homo sapiens
  misc_feature: GZ8MTXP02GM45Y.11.67.G01.1.454.CMB.2.raw
  modified_base (472)..(472): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttaattttaaaaggtgtccagtgtgaggtggagttattgcaggtcggtgggggggtcttggtgcgaggccggaggggtccctgagactctcctgtgtaggctcgtggtattcgtagtttagctacgctacgcccagtccgaccgtcggggtccccgaccgacggccgtccggaaggggacggggtcgtaggggacggttcggggtccgttccgggacttagttaaaggtccggacccccgtaacggggtcggaacgaaacggacaacgttaaccgtacgacgaacggtacgttcccgggngacggacgggacgtacgtccgaccacctacgtccaccgagaacgactaacctaccgaaagaaccgtaccgtacgtacgtaaccgtagaacgtaaacggtacgaacgtacggtactaagggaccggaaccggacccgtaaacgaaccggaaccggttacttaagttaaccgttacgtacggaccgaaccgttaaacgaaccgttaacccgtacaaacgttacttacgtccgtacgtcggtagg

SEQ ID NO: 388643 - DNA, 848 bp, Homo sapiens
  misc_feature: GZ8MTXP02HVXE1.11.67.G01.1.454.CMB.2.raw
  modified_base (197)..(197): a, c, t, g, unknown or other
  modified_base (226)..(226): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcgagggtcctgggcccagtctgttctgactcagcccaacctcagcgtcgtcggggaccccggnagagaactcaccatctcttgtactggaancagcctaccaatacgtacggaaacgtaacgatcgtactaagtttggtactacgaactacgtacccgtaccccgggtaaccggaccccctaaaactcctactaacttcgtaagtaaggaactacggccgacggcccggtccccgtacggaccgggggtttcccctgggtaccggtactttccgtcggtacggaccttacggaacgttccgtaccgggaccctaccgttccgaccgtccccgttcccggtcgggtccccgtaggacccgtacggggttccgggaccgtttacccgtagttacccggtgggtacgggtagtcggggtacgggtcttaacggttacgttaagtttacggtttcggtacgtacggtagggttaccgggttagggggttacttacgggggtaccggttacggttcggggacggttcgtcgggttccggggtttgggtttccggggttacgggggaacccggggtaacggggtacccttaacggggtcccggttaccggggtaaccccggtttccgggtaccgggggttaaccgaccggggttaaccccggaaacggggttcctacccccggggtcccccggttacgggtccctttaccgtttccccgg

SEQ ID NO: 388644 - DNA, 668 bp, Homo sapiens
  misc_feature: GZ8MTXP02G6BY8.11.67.G01.1.454.CMB.2.raw
  modified_base (274)..(274): a, c, t, g, unknown or other
  modified_base (289)..(290): a, c, t, g, unknown or other
  modified_base (297)..(297): a, c, t, g, unknown or other
  modified_base (434)..(434): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggtcgttttctggtggcttaattttaaaaggtgtcagtgtgaggtggagttattgcgtaggtcggtggggggggtcttggtgcgagccggaggggtcctgagctctctgtgtggctcnggtatcaggtttacnncgctacnctgtcgtccgtcggccgcgcggcgacggagggacgggcggtgggtacggtcggtcgtcggtacgttagttacggtcggacccggtaggtcgacgtaacgactaacgtaaccgtccgacgtaacggtccggttaccgnggacggtacggggacctagtccgaaccctacgtacgtacccgaacgaacgaaccgtaacgtaaacctaccgaaaagaccggtaaccgtaccgtaccgtacgtacgaaacgaacgtacgaactacggacgtaggacgaccggccgaacgtacccgtacggttacctagttaaccgtagttacgacgaacgtaacgtacccgtaacgacgtagtacttacgtcgtacgtacgtcgg

SEQ ID NO: 388645 - DNA, 580 bp, Homo sapiens
  misc_feature: GZ8MTXP02HPCGN.11.67.G01.1.454.CMB.2.raw
  modified_base (409)..(409): a, c, t, g, unknown or other
  modified_base (429)..(429): a, c, t, g, unknown or other
  modified_base (485)..(485): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtccagtgtgaggtggagttattgcagtcgtggggggggcttggtgcagccggagggggtccctgagactctcctgtgtagctctggattcagttttagcagctacgccatcgaccgtgggtcccgccgaggcctccggaaggggacggggcgtgggaggtcgggtctcgggactattagtcggccccgagggtgacaagacacttacgtcgcagacgttccgngcgagggccatcgaccaccngtccaccgagacgaactaactacccgagaacgacgctagtacctgacaaagtgacngaccagacgacggccgacgaccgacggacctataacttacgcgtacgacctaagaaacctcccggtacagtactacttcggacctacggttacgg

SEQ ID NO: 388646 - DNA, 623 bp, Homo sapiens
  misc_feature: GZ8MTXP02JYCSJ.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttattttaaaaggtgtccagtgtgaggtggagttattgcagtcggtgggggggcttggtgcgagccggagggggtccctgagactctcctgtgtaggctcgtggtattcgtagttttagcagtctacgccatcgaccgtgggtccgccgaggcctccgaaggggaaggggcgtgggaggtcgggtctcggcttaagttaagtggccccgacgggtcgacaagacatactacgcagacgtccgtgcgacgggccgagtcgaccaccgactcctaccagacgaaccaaacttcccgaagaaacgaccgcgtacgtacccgtagaccaaagtggaaccacgccgtaggaacggacggacccgaacgtaaccgaccggtaccgtaatacttaccgtagtaccgaccgaagtaaaaccgtcccgtaccgaacgtatagttacgacctacgttcggg

SEQ ID NO: 388647 - DNA, 649 bp, Homo sapiens
  misc_feature: GZ8MTXP02GD0UK.11.67.G01.1.454.CMB.2.raw
  modified_base (207)..(207): a, c, t, g, unknown or other
  modified_base (211)..(211): a, c, t, g, unknown or other
  modified_base (236)..(236): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggnaganaatcaccatctcttgtactggaacncagcctacaatagtacggaaagtaacgatgtacaagttggtatacaacactcccgtaccccggtaaccgacccccaaactcctcatactaagtaggaatacgccacgccggccctcgacggggtccctcggccccgtacttctcgtcgtctacgaagtcgtcgctacctcacgccctccgtcggccctgccgtaggtcgggtcctaccgtacgtcgtggaacggtataggacggtcttacgtaacttagttagttggtacgacgacggtcgggtagggacgttacggtacggttcgtggtaggtcgtcgttgggttcggttaccgggttcggggaccggggtaacgggacccgtaaggtcccgtacgggtaccccggttccggttacggggtaccgaccggtacccgaacggg

SEQ ID NO: 388648 - DNA, 894 bp, Homo sapiens
  misc_feature: GZ8MTXP02JSA2T.11.67.G01.1.454.CMB.2.raw
tcagcgagagataccacgaccggtgctcgatttagagtatacatattgggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaacgacgctgtacctgcaaatggacagcctgagagccgacgacacggccgtatattactgtgaccaagaaactccgtaccaagtataagtttcgaccctacgtgggtacggcctaaacgtcgacttaccggacccgtacccttaaccttaattaacttacccaacccctaaacgtaaacgttacggggaacccggtttaccggttaacggggggacccgaaaaaacccgggggtaaccccgtaaacccgggggttaccgtaaaccggttccgggttaccccgtttacccccttacccgaaaccgggtcccccttacccccggaaccccgaaacccggggggtacccccctaaaccgttacccccgggggtttaccccccttttacccccccccgggttccggggtacccccccgttaaccccccttacccccgttaacccccgtaaaacccggtaacccggacccccgtaaaccccgtttcccgggttacccggggggggtaccctaaaccccgggtaccgggaccccgggggttcccccccggtttcggggggtttacccgttcccccgggtttaccgggggttaacccggtaaaaccgggggtttaaacctttaaccccggtttttaaacccccggggg

SEQ ID NO: 388649 - DNA, 594 bp, Homo sapiens
  misc_feature: GZ8MTXP02I74PG.11.67.G01.1.454.CMB.2.raw
  modified_base (193)..(193): a, c, t, g, unknown or other
  modified_base (244)..(244): a, c, t, g, unknown or other
  modified_base (477)..(477): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccacctcagcgtctcggggaccccggnagagaatcaccatctcttgtactggaagcagctacaatatcggaagtacgntgtacaattggatcaacatcctaccccggtacgcccccaaactcctacatctataggaatcgccagccggaccctcgacggggtcccctggccgtatttccgtcgtggccttacggaaccgtcgtcggacctacccgtcacgccccttcccgtggcccttgcaggtcggcctcgagtctggacgtatggagtctgaacttattagtgtgcgtggtcggtggtatgtacgggtntagagtcgcttgggtcggttcgtcgggcggtaacgggccgtaaaggccgtacgacccgttcgtaacgtaccgacgcccgtaacggcctcggcccccgttggtaccctacgtttcccg

SEQ ID NO: 388650 - DNA, 595 bp, Homo sapiens
  misc_feature: GZ8MTXP02GQQBQ.11.67.G01.1.454.CMB.2.raw
  modified_base (304)..(304): a, c, t, g, unknown or other
  modified_base (331)..(331): a, c, t, g, unknown or other
  modified_base (403)..(403): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagcgtggcttttcttgtggctattttaaaaggtgtccagtgtgaggtggagttattgcagtcgtgggggggcttggtgcagccgaggggtccctgagactctcctgtgtaggctctggattcagttttagcagctacgccatgacctggtccnccaggctccgaggggaaggggctaggngtggggtctcgggctattaacgtggaccccgacgggtggcaaacggacacttaacgtcgcagacgttccggngcgacgggccagcgccacagtcacgagacgaactaacgtaccgaagaacgcgtacgtacgtacgtagaactaaagtcgaacgtacgacgtagacgacggtaccgaacgaccgacggtacgttaagttacgttacgtacggtacgacgtaaacgtaacgtccgtaacgacgtacttacgtcgaccgtacgtgg

SEQ ID NO: 388651 - DNA, 725 bp, Homo sapiens
  misc_feature: GZ8MTXP02JAJIX.11.67.G01.1.454.CMB.2.raw
  modified_base (247)..(247): a, c, t, g, unknown or other
  modified_base (296)..(296): a, c, t, g, unknown or other
tcagcgagagataccacgaccggtgctcgatttagagtatacatattgggtttgggggggttgagaagacaggactcaggacaatctccagcatggccagcttccctctcctcctcactctcctcgctcactgcacagggtcctgggcccagtctgcgctgacgcagcccgccctcagtgtcgtcggggccccagggcaggagggtcgccatctcctgcacgtggtccactcaatgtcgggcgttanggtatgctcgtggtatacaacacgtcaggatcggaccccaaactcctanatctatcgctacgaacaacactcctacccgttcgacggggttcccctaggtaccgttcgtctcggtacctcgaacgtctcggtccttccttcccgtcttacccgttcggcctacgtcgaacggtcggggtacctcggacggtcgtcggaacgtagtcgggaggtacctaggttaaacttaccgtcgttcggttcccgttagttacccgttagtaccggaaaccgggttaaccgaaccgttaaccggacgtttaacccggtttttccgggggttaaccggggacggggtaaagggtaacgtttaacgaccgtttacggtaaccccgttaaacgaaacggttcccgaaaccgggtccccgtaaaggggtcccttcccccggggtccccgttacggtaccctttacccggtccgtttacccggtttcccccc

SEQ ID NO: 388652 - DNA, 622 bp, Homo sapiens
  misc_feature: GZ8MTXP02FE9V2.11.67.G01.1.454.CMB.2.raw
  modified_base (177)..(177): a, c, t, g, unknown or other
  modified_base (198)..(198): a, c, t, g, unknown or other
  modified_base (256)..(256): a, c, t, g, unknown or other
  modified_base (387)..(387): a, c, t, g, unknown or other
  modified_base (501)..(501): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagcccaccctnagcgtctcggggacccccggnagagaatcaccatctcttgtactggaagcagctaccaaatagtacgggaaagtaacgnttgtactaattggtatcaacatcccgtaccccggtaccggaccccccaaactccctcatcctataggaactagccagccggccctcgacggggtccctggccgattctcgtagctacggaacgtcgtggcncctcacgcccttcccgcggccttgcgtagtcgggacctcgagtcgtggaggactggaggtcagtacttagtttagttcgttgacgtacggcggtggggtagtacggtacgggtntcggagttcggtcggttggttgggttccgttcggggaccgggaacggaccgaggtccgtacggtaccgtccgtcgggactacggaaccgacggcccgtccgccccgtcgactccgttcccg

SEQ ID NO: 388653 - DNA, 598 bp, Homo sapiens
  misc_feature: GZ8MTXP02FTERR.11.67.G01.1.454.CMB.2.raw
  modified_base (193)..(193): a, c, t, g, unknown or other
  modified_base (221)..(221): a, c, t, g, unknown or other
  modified_base (374)..(374): a, c, t, g, unknown or other
  modified_base (381)..(381): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaancagctcaatatcggaatacgatgtcaattggtatcaacatcctccccggtacgcccccaaactcctcatctataggaatgccagccggccctcgacggggtcccctgggccattcctcgtggctcggaagtctcggcacctcacgccctccgngcctgcngtcggctcagtctgagatgagctgacttattattgtgcgaggtcgggtaggagtcggtacggttcgtagtaggtcggcgttgggttggtacgttcggggcggggaacgggaccgaaaggtccgtacgggtacccggttccggttacggggtaccgaccggaaccccggaaacggtcccgtcccgccccccggttcggtacccgtaccgtttccccgg

SEQ ID NO: 388654 - DNA, 619 bp, Homo sapiens
  misc_feature: GZ8MTXP02FO5LV.11.67.G01.1.454.CMB.2.raw
  modified_base (394)..(394): a, c, t, g, unknown or other
  modified_base (399)..(399): a, c, t, g, unknown or other
  modified_base (425)..(425): a, c, t, g, unknown or other
  modified_base (428)..(428): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtccagtgtgaggtggagttattgcaggtcgtggggggggtcttggtgcgagccggagggggtccctgagactctcctgtgtaggctctggattctagtttagcagctacgccatcgaccgtcgggtccgccgaggctccgaggggagggcgtggaggtggtcgtcggctagttaagtcggcccgtacggtggacaagacactactcgnaacgngtaccgtgcgacgggccatcgcacgntcncagacgacaactcccaaagacgaccgctacgtacccgtagaacaaaacgttcggaaactcgtaccgtaggaacgacgacccggtaccgacccgtaaccgggtcccgttaaagtaccttttaacgcgttacgaaccgtaaagtaaccgtaacccggtaccaaaggttactaagttcggacctaaggttcggg

SEQ ID NO: 388655 - DNA, 530 bp, Homo sapiens
  misc_feature: GZ8MTXP02GORON.11.67.G01.1.454.CMB.2.raw
  modified_base (195)..(195): a, c, t, g, unknown or other
  modified_base (222)..(222): a, c, t, g, unknown or other
  modified_base (233)..(233): a, c, t, g, unknown or other
  modified_base (244)..(244): a, c, t, g, unknown or other
  modified_base (333)..(333): a, c, t, g, unknown or other
  modified_base (349)..(349): a, c, t, g, unknown or other
  modified_base (402)..(402): a, c, t, g, unknown or other
  modified_base (422)..(422): a, c, t, g, unknown or other
tcagcgagagataccacgaccggtgctcgatttagagtatacatattgggtttgggggtgttgagaagacaggactcaggacaatctccagcatggccagcttccctctcctcctcaccctcctcactcactgtgcagggtcctgggcccagtctgttctgactcagccaccctcagcgtctgggaccccccggnagagaatcaccatctcttgactggaancagctccaatntcggaatacgntgtcaatgtatcaacatctccccggtacgacccccaaatcctcatctatagatagccagccggcctgacggggtccctggccgtattcnctggctccgaagttcngggcaccgtcacgcctccgtggcctgaccaggttcgggacctccagtctgagntgagctagacttatattgtncgagcgtgggatgacgtctgagtgctgtcggtacgttcgggcgagggaccagcgtggacccgttcgagggtccaacgtccaacggctaccgccccctacggtccaccg

SEQ ID NO: 388656 - DNA, 648 bp, Homo sapiens
  misc_feature: GZ8MTXP02GAK7D.11.67.G01.1.454.CMB.2.raw
  modified_base (326)..(326): a, c, t, g, unknown or other
  modified_base (544)..(544): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggcttattttaaaaggtgtccagtgtgaggtggagttattgctaggtcggtggggggggtcttgggtgcgaggccggtagggggtccctggacgactctcctgtgtaggctcgtggattctagtttagcagcctacgccaatcgaccgtcgggtccncgacggcctcggaaggggaacggggccgtgggaggtcggggtcctcgggtacttaagttaagtcggaccccgacgggtggacgaaaggtacaagtaccgtacggcaaggacgttccggagcgaacggggcccagtcgacccgaccagtccaccgaagacgaacctaactcccgaaagtacgaccgtcgtacgtaacctgaacctaaagcggaaacccncgtacgaggacgacggaccgacgtacgaccggtacttaacgtacgtacgtacgacgaaccgtaacgtaaccgtccgtacaacgtactacgtcgacgtacggtcg

SEQ ID NO: 388657 - DNA, 699 bp, Homo sapiens
  misc_feature: GZ8MTXP02I7I65.11.67.G01.1.454.CMB.2.raw
  modified_base (209)..(209): a, c, t, g, unknown or other
  modified_base (213)..(213): a, c, t, g, unknown or other
  modified_base (224)..(224): a, c, t, g, unknown or other
  modified_base (236)..(236): a, c, t, g, unknown or other
  modified_base (239)..(239): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtcgtcgggacccccggnaganactcacatctnttgtacgtagancancctacaatacgacggaagtaacatgtactaagttgtactacaactactcccgtaccccggtacccgacccctaactcctactactactaagtaagaactacgaccgacgcccggtcccgtacggtaccgggtcccgtcggccccgtacttccgtcgtcggtactacgtacgtcgtcgacctaccgtaccgccgtccccgtcccgtcgtccgtcgaccggtacgggtcggtcctaccgtagtccggtaggtacggtagtcggtcggtacgttacgttaacgtttagtttagttcggtacggtaccggtacgggttcgggtaggggtacggttacgggtacggttgtacgggtcggttcgggttcgttggggttacggttccgggttacgggggaccggggtaacggaaccgtacggtccgtacggtacccggtcggtacggaccgaccggtacccgtacgg

SEQ ID NO: 388658 - DNA, 797 bp, Homo sapiens
  misc_feature: GZ8MTXP02IATSD.11.67.G01.1.454.CMB.2.raw
  modified_base (176)..(176): a, c, t, g, unknown or other
  modified_base (198)..(198): a, c, t, g, unknown or other
  modified_base (202)..(202): a, c, t, g, unknown or other
  modified_base (211)..(211): a, c, t, g, unknown or other
  modified_base (228)..(228): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagcccaccctnagccgtctcggggacccccggnaganactcacctntctcttgtactaggaancacgcctacaaatacgtacggaaagtaacgtatgtactaagttggtactacaactacgtcccgtacccccggacccgaccccctaaactcctactactacgtaagtaaggaactacgccgacggcccggtcccgtcggtaccgggtcccgtcgggtcctacttccgtcgtcggtcgtacggtacgtccgtcggacctaccgtcgtaccgtcccttcccgtcgggtccctcggaccgtcggggtccgggtacccttccgtacggttcgtaggtacgggtagtacgggacggttacgttacgttaacgtttagttacggttcggtacggtacggtacggggttcggggttaaggggttacgtacggggtaccgggtttggtagggtacggttggttacgggtttcgggtttcggggttaccgggttaccgggggacgggtaaacgggtaccggtacggttccggtaccggggtacccggtttacggggtccgggtaaccgacccgggtaacccggtaccgggtccccgttaccccgggtccccggttccggttacccgttacccgtccccg

SEQ ID NO: 388659 - DNA, 546 bp, Homo sapiens
  misc_feature: GZ8MTXP02H8D4V.11.67.G01.1.454.CMB.2.raw
  modified_base (258)..(258): a, c, t, g, unknown or other
  modified_base (517)..(519): a, c, t, g, unknown or other
  modified_base (521)..(524): a, c, t, g, unknown or other
  modified_base (526)..(532): a, c, t, g, unknown or other
  modified_base (534)..(536): a, c, t, g, unknown or other
  modified_base (538)..(539): a, c, t, g, unknown or other
  modified_base (541)..(542): a, c, t, g, unknown or other
  modified_base (544)..(546): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaaatggacagcctgagagccgacgacacggccgtatattactgtgccagaaatccgtccagatattgcactggtgcaactgctacgacgcctactattatcacanatggacgtcgtggggacaaagggacccacggtcatccgtctcctcagcctccacgaacgggcccagtccggtccttccccctggcccctacccctcctaccaagcgccaccctcgggtgggggccaacgacggcccgggtcccgtgggggccttcggcccgttgggtaccgaaacgggtaccttaccgtttcccgtattcctacgttcgccgttggacggccggggactcggggaccgaacggggccgacaacgtaggnnngnnnncnnnnnnncnnngnncnncnnn

SEQ ID NO: 388660 - DNA, 702 bp, Homo sapiens
  misc_feature: GZ8MTXP02FTMKN.11.67.G01.1.454.CMB.2.raw
  modified_base (174)..(174): a, c, t, g, unknown or other
  modified_base (195)..(195): a, c, t, g, unknown or other
  modified_base (223)..(223): a, c, t, g, unknown or other
  modified_base (249)..(249): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctnagcgtcgtcgggacccccggnagagaatcaccatctcttgtactggaancagctaccaatatcggaaagtaacgntgtactaattggtatcaaacactctcccccggtacggacccccaaactcctcatctataggaatagccagccggccctacgacggggtccctgggccgtattcgtcgtggctcggaacgtctcggactacctcacgtccctcccgtggaccctgccgaggtcggggcctacccgtagttccgtaggaacggtgtagggacggtacctaggtaaccttttaagtttaacgttggttcggaccgttagggtcgggtttacgggggatttacggggtaaccgggttacgtgggtaggttcggtcgtttggggttcgggttacctttcgggggacgggaacgggtaaacccgaggtcccgttagggtaccccggttcgttacgggggtccaaacggaaccccgtaaggggtcccttccccgggtccccccggttggtaccccctaccgtttccccgg

SEQ ID NO: 388661 - DNA, 540 bp, Homo sapiens
  misc_feature: GZ8MTXP02FNH01.11.67.G01.1.454.CMB.2.raw
  modified_base (247)..(247): a, c, t, g, unknown or other
  modified_base (380)..(380): a, c, t, g, unknown or other
  modified_base (406)..(406): a, c, t, g, unknown or other
  modified_base (409)..(409): a, c, t, g, unknown or other
  modified_base (450)..(450): a, c, t, g, unknown or other
  modified_base (533)..(533): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctcgggacccccggcagagaatcaccatctcttgtactggaagcagctaccaatatcggaagtaacgntgtcaattggtatcaacatcctccccggtacggaccccccaaactcctcatctataggaatagccagcggcccctgacggggtcccctggccgtattctctcggctacgaagtctggcacctcacgcctcccnggcctgccagtggctccagtctgagntgngctgactattattgtgacaggcgtagggatggacgtgtagngtgctggtggtcgtcgggcgggtaggacgagctacggaccggtccgttcgggcacgcccgaaggcctcgcccccgtggtaccnccttccg

SEQ ID NO: 388662 - DNA, 768 bp, Homo sapiens
  misc_feature: GZ8MTXP02JDLZ9.11.67.G01.1.454.CMB.2.raw
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtccagtgtgaggtggagttattgcaggtcggtgggggggtcttggtgcgagccggaggggtccctgagactctcctgtgtagctctggattcagtttagcagctacgccagtcgaccgtgggtcccgccgacggtcctaccggagggggaaggggtcgtagggaggtcggggtccgtcgggtaccttaagttaaacgtcgggaccccctaacggggtggaccgaaaacggaccgtaacttaaccgtaccgaccgtaacggtaaaccggtcccggtggacccggaacgggggcccgtaaacgtccggaccctaaccctaccgttacccgttacccgaaaacggttaccggaaaaccgtaaacccttaacccccgaaaggaaaacgtaacccggtaccgttacggtaaacccccgttggaaccgtaaaacgtacgggaaccctacggtaccctaaggacggaaccggaccccggaaccgaaacccggtaccggtacccgttaataaccggtttaccgtacggtaccgtaaccgaacggtaaaacctccggtaccaaggtacttaagtccgtacgtacgtacggg

SEQ ID NO: 388663 - DNA, 615 bp, Homo sapiens
  misc_feature: GZ8MTXP02F1SIN.11.67.G01.1.454.CMB.2.raw
  modified_base (197)..(197): a, c, t, g, unknown or other
  modified_base (226)..(226): a, c, t, g, unknown or other
  modified_base (335)..(335): a, c, t, g, unknown or other
  modified_base (345)..(345): a, c, t, g, unknown or other
  modified_base (370)..(370): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctcagcgtcgtcgggacccccggnagagaactcaccatctcttgtactggaancagctacaatatacggaataacgatgtactaattggtatcaacatccgtccccggtacgcccccaaatcctacatctaatagatacgccagccgcctgacggggtcccnggcctattcncgtggctcgaacgtctggacacctnacgtcctccgtgcctgcaggtcggctccagtcgtaggagtactggagtactgtaacttattacgttggtagcgtaaggtcggttaggggtagtcgggtacgggttctggtagtgtacgttggtcggttcggtcggggacgggtacgggacctaacggtccgtacggtacccggtccgttacggggcctaaccggtaacccgaacggtccctcccggtcccccgttcggtcctaccgtttccccgg

SEQ ID NO: 388664 - DNA, 700 bp, Homo sapiens
  misc_feature: GZ8MTXP02FVXNH.11.67.G01.1.454.CMB.2.raw
  modified_base (177)..(177): a, c, t, g, unknown or other
  modified_base (198)..(198): a, c, t, g, unknown or other
  modified_base (226)..(226): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagcccaccctnagcgtcgtcgggacccccggnagagaatcaccatctcttgtactggaancagctaccaaatatacggaaatacgatgtactaagttggtaatcaaactactccgtcccccggtaccggaccccccaaactcctacatactaataggaatagccagccggccctcgacggggtcccctgggccgtatttccgtctcgggtcctacggaacgttccgtcggacctacccgttcaccggtccccttccccgtcgggccccttggacccgtagggtcgggccttcccgtagttccgttggaaggtacgtgggaggtcgtagtaacttagtttagttggtacgcgtagggcggttggggaacgtcgggtacgggttcgtagggtaggtcgtcggttgggttcgggttcggttcggggacggggaacggggacctaaacggtcggtaccggtacccggtccgtacggggtaccgacggaacccggaacgggtccctcccggtacccccgtggtaccctacgtttccccg

SEQ ID NO: 388665 - DNA, 669 bp, Homo sapiens
  misc_feature: GZ8MTXP02HEPPQ.11.67.G01.1.454.CMB.2.raw
  modified_base (208)..(208): a, c, t, g, unknown or other
  modified_base (235)..(235): a, c, t, g, unknown or other
  modified_base (573)..(573): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtcgcgggacccccggnagagatcaccatctcttgtactggaancagctaccaatagtacggaagtaacgatgactaagttggtatacaactatccccgtcccccggtaacccggacccccctaaactccctacactcctaaagtaaggaactacgacccacggtccggcccctcggacggggtccccgtggccccgtacttccgtcgtacggggtcctacggaacgttccgtcgggtacctaccgtccgaccgtcccctcccgtcggccctggaccgtacgggtcgggcctcccgagtccgtaggaggtacgtaggcgtacgtggtaacctttagttagttggtcgcgtacgggtcgtgggtagtcggtaccgtggtaggngttcgcgttgggtacggttccggtcggggtacgggaacggggccgtaaacggcgttacggccggttcggtacggaccctaccggaccgtaccgggg

SEQ ID NO: 388666 - DNA, 615 bp, Homo sapiens
  misc_feature: GZ8MTXP02FHOAI.11.67.G01.1.454.CMB.2.raw
  modified_base (176)..(176): a, c, t, g, unknown or other
  modified_base (219)..(219): a, c, t, g, unknown or other
  modified_base (341)..(341): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctnagcgtcgtcgggaccccggcagagaatcaccatctcttgtacnggaagcagctaccaatatcggaaagtacgatgtctaattggtatcaacatcctccccggtaccggaccccccaaactcctcatctataggaatacgccacgccggccctcgaggggtccccnggccgattctcgtcggctacgaacgtctcggcacctcacgcctcccgtgcctggctaggtcgggcctccgagtcgtgaggatggaagccgtagtacttaagtttagttcgtgccgtagggtccggtgggggaattcgggtaaccggtgtacggagttgtccggtggttgggtccggttcggggacgggacggggaacacggtactcgggtaacgtccggtcgggaccacggaacccgtacgccgtcccgtcccccgtcggtaccactttccccg

SEQ ID NO: 388667 - DNA, 773 bp, Homo sapiens
  misc_feature: GZ8MTXP02GCMWK.11.67.G01.1.454.CMB.2.raw
  modified_base (199)..(199): a, c, t, g, unknown or other
  modified_base (255)..(255): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagcccaccctcagcgtcgtcggggacccccggnagagaatcaccatctcttgtactggaagcagctaccaatagtacggaaagtaacgntgtacaagttggtatcaaacactccgtacccccggtaccggacccccctaaactccctactactctaagtaaggaaatacgccctaagcccggacccctcggtaccggggtcccctacggggtcccgtaatttccgtcgtcggaccgttacggtaaaccgttccgtcgggaccctaacccgttcgacccgttcccccgttccccgtccgggtcccgttcggacctaggggtccggggtaccttacccgtaacgttccgtagggaacgggtagttgggaacggggtaccttaggttaaaccttagttttaagttcggttgaccgtacgggtcgggttaggggtagttacgggtacgggttacggtacggtagttggccgtttgggtcggttccggttcggggacgggacgggaaccgaacggtcgtaccgggtacccgttaccggtcggggtaccaacgggaacccgtaacgggtcccgtcccgggtaccccccgtttcggtaccctaccccgtttccg

SEQ ID NO: 388668 - DNA, 599 bp, Homo sapiens
  misc_feature: GZ8MTXP02GPHLO.11.67.G01.1.454.CMB.2.raw
  modified_base (208)..(208): a, c, t, g, unknown or other
  modified_base (236)..(236): a, c, t, g, unknown or other
  modified_base (462)..(462): a, c, t, g, unknown or other
  modified_base (519)..(519): a, c, t, g, unknown or other
  modified_base (524)..(524): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccggnagagaatcaccatctcttgtactggaancagctaccaatacgtacggaaagtaacgatgtcaaattggtaatcaaactactccgtcccccggtaaccggacccccctaaaactccctacaatccttaagtaaggtaaactacggacccacggccggtcccctcgacgggggttcccctggggccccctattcctctcggctacgaagtctggccacctcacgtccctccgtggccctgcagtcggctcgagtcngaggtactgaggtctagacttattagttggtgcgagcggtgggtacgtggaccggtntaggngtgcgttggtcggtcgttcgggacgggacggaccagtccgtcggtaccgtcgtcgggtacaccggaccgtaacgg

SEQ ID NO: 388669 - DNA, 916 bp, Homo sapiens
  misc_feature: GZ8MTXP02JZZCQ.11.67.G01.1.454.CMB.2.raw
  modified_base (212)..(212): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagcccaccctcagccgtcgtcggggacccccggnagagaatccaccatctcttgtactggaagcagcctaccaatagtacggaaagtacgatgtactaagttggtataccaaactcttccccgtacccccggtaccgaccccctaaactccctacacttctaagtaacggaaatacgccccgtaaggcccggtaccccgttcgggtaacccggggttcccccgtacgggtcccccccggttattttccccgtccgtttcggggtcccgttaaccgggtaacgttcccggttacggtacccctaacccccgttccgtacccgtccccccgtttccccgggtcgggcccccgttaggcccggttaacggggttcccggggtcccctttaccccggaggtttaccccggttaacggggtaacggggttaagtcggggtaccgggttacccggtttaacggttaacccggttttaaacgttttaaggtttcgggtttaaccgggccgttagggggtacccgggtttagggggtacgttacgggggtaaccgggtttcgtaacggggttacggttcggtccgggggttttacggggttccggggttttaacccggggtttcggggggacccggggtaaaaccgggggtacccgttaaacggggtcccggtttaccccgggtaacccccgggggttcgttaccgggggtacccggaaccccggtaccccgggtaaaccccgggg

SEQ ID NO: 388670 - DNA, 603 bp, Homo sapiens
  misc_feature: GZ8MTXP02H3KER.11.67.G01.1.454.CMB.2.raw
  modified_base (249)..(249): a, c, t, g, unknown or other
  modified_base (287)..(287): a, c, t, g, unknown or other
  modified_base (314)..(314): a, c, t, g, unknown or other
  modified_base (349)..(349): a, c, t, g, unknown or other
  modified_base (455)..(455): a, c, t, g, unknown or other
  modified_base (507)..(507): a, c, t, g, unknown or other
  modified_base (556)..(556): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttctgtggtctattttaaaaggtgtccagtgtgaggtggagttattgcagtcggtgggggggcttgggtgcaggccggaggggtccngagtacctctcctgtgtaggcttctggattcagtttancgagctacgccatgaccgtgggtcccncgaggctccgaggggaagggctggagtcgggtacnccggtactaagttaacgtcggccccgtaacggtgacgaagacgtactaacgtccgccgaaggacgttcccgaggcacggggacccgtagcgacctacccattcccnccgaagacgactaacgttccaacgaacgacgtcctagtaccctgacctaagnggacacgcgtcgagacgaccgaacgtacgacggacgtactaatttaccncgtacgaccgtaacgaactccgactacgtactatcgacgtacgtcgg

SEQ ID NO: 388671 - DNA, 638 bp, Homo sapiens
  misc_feature: GZ8MTXP02ID54H.11.67.G01.1.454.CMB.2.raw
  modified_base (196)..(196): a, c, t, g, unknown or other
  modified_base (210)..(210): a, c, t, g, unknown or other
  modified_base (226)..(226): a, c, t, g, unknown or other
  modified_base (371)..(371): a, c, t, g, unknown or other
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagccgtctggggacccccggnagagaactccaccntctcttgtactggaancagcctacaatagacggaaagtaacgatgtactaagttgtatacaactactcccgtaccccggtaccgacccccaaactcctactactactaagtagaatacgccgacggccggcccgtcggtaccggggtccctcgggaccgtnttctcgtcgtcgtacgtacgtcgtcgcctacctcaccgtccctccgtcgtctcgcgtcgggtcggtcctacgtagtcgtggaggtagtggacggtctagtaacttattagttgcgcgagggtcggtagggtagtcgggtacggtgtaggtagttcggtcgttgggttcggtcgggtcggggacgggtacgggaccgacggtcgtacggccggtccggtcggaccacggtcccgacggtccgtcccgtcccgtcgtccgtaccgtccg

SEQ ID NO: 388672 - DNA, 674 bp, Homo sapiens
  misc_feature: GZ8MTXP02G1JA4.11.67.G01.1.454.CMB.2.raw
  modified_base (210)..(210): a, c, t, g, unknown or other
  modified_base (222)..(222): a, c, t, g, unknown or other
  modified_base (240)..(240): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcacgccaccctcagcgtcgtcgggacccccggnagagactcactntctcttgtacgtaggaancacgtcctaccaatacgtacggaaagtaacgatcgtactaagttgtatacaactcctcccgtaccccggtacccgaccccctaaactcctactacttactaagtaagaactacgacccgacggtccggtccccgtacggtaccggggtcccgtcggcccctattccgtcgtcggctacgacgtcgtcgcctacctcaccgtccctccgtcgcctagcgtacggtcggtcctccgacgtcgtaggaggtagtggacgtcgtagttacgttagtttcgtggtcgacgtacgggtggtagggtagttcgggtacgttcgtgtacggttcggtcggttgggttccgggtttcggtacgggggtaccgggtaacgggtaacctacggtcgtaccgggtacccggttcgggtaccgggtaccacccggtacccggtacgg

SEQ ID NO: 388673 - DNA, 810 bp, Homo sapiens
  misc_feature: GZ8MTXP02JUW1P.11.67.G01.1.454.CMB.2.raw
  modified_base (211)..(211): a, c, t, g, unknown or other
  modified_base (215)..(215): a, c, t, g, unknown or other
  modified_base (240)..(240): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcacgcccaccctcagcgtcgtcgggacccccggnaganactcactatctcttgtacgtagacncagtctacaagtagtacggaagtacgtatgtactagttgtatacactcgtcccgtaccccggacccgacccctaactcctactatactaagtacgtaactacgaccgacggtccgtacccgtacggtaccgggtcccgtcggtaccccgttacgttccgtcgtcggtaccgtacgtacgtcgtccggacctaccgtccgtaccgtccccgttcccgtaccggtcccgtacggtaccggtacgggtccgggtacccttaccggtacggttaccggtacggggtaacggtacggtacggggtaacgttaccgttacggttaaacgttttacgtttacggttacggtaccgggtaacggtacggggttacggggttacggggtaacgttacggggttaccgggttacgggtaacgggttacgggtttacggttaccgggtttacgggggtttccggggttacccggggttaaccgggggtaacggggtaaaccggttaaccggtaacggttcccgtaaaccgggttaacccggttaaccgtaaccgtaccggtaaccggaaccccggtaacgg

SEQ ID NO: 388674 - DNA, 557 bp, Homo sapiens
  misc_feature: GZ8MTXP02FQZLS.11.67.G01.1.454.CMB.2.raw
tcagcgagagataccacgaccggtgctcgatttagagtatacatattgggggggtttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacgccgtatatactgtgcagaaatccgcagatattgcactggtgcaactgctacgcgcctatattatcaccacatgacgtcgtgggacgaaagggacccacggcatcgtctcctcacgcctccaccgaaccggcccaacgtccggtacccttcccccgtcggcccacccctccctaccaacgtacgccaccgtcgtcgggggaccacgacgtccggcccgtcgggctcggtccgtggtaccaacggtacctacgtttacccg

SEQ ID NO: 388675 - DNA, 598 bp, Homo sapiens
  misc_feature: GZ8MTXP02IZJ3A.11.67.G01.1.454.CMB.2.raw
  modified_base (575)..(575): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggtctttttcttgtggctattttaaaaggtgtccagtgtgaggtggagttattgcagtcgtgggggggcttggtgcagccggagggggtccctgagactctccgtgtgtaggctcgtggtattcagttttagcagcctaaccgccatcgacccgtgggtcccgccgaggcctaccgaggggaaggggcgtagggaggttcggggtactccggtacttagttaagtcggccccgtacgggtgacaaacggacactaacgtacgcaggaacgtccgtgacgagggcccatcgaccacactcaccagagaaccaacttacccgaagaacgacaccgtacgtacctagacaaacgtgaacacggcctagacgacgaccgacgacgacgccgtatacttcgagtacgaccaagtaaactcccganaagtactagtacgctaacgttgg

SEQ ID NO: 388676 - DNA, 732 bp, Homo sapiens
  misc_feature: GZ8MTXP02IYUC0.11.67.G01.1.454.CMB.2.raw
tcagcgagagataccacgaccggtgctcgatttagagtatacatattgggtttggggagctctgagagaggagcccagccctgggattttcaggttgttttcatttggtgatcaggactgaacagagagagctcaccatggagtttgggctgagctggtctttttcttgtggtcttaattttaaaggtgtccagtgtggaggtggtagttattgctaggtcgggtggggggggtcttgggtgcgaggccggaggggtccctgagctctctgtgtagctcgtgtattctagtttacgcagctacgcctagtcgaccgtcgggtcccgccgaggccgtaccggaaggggaacggggtcggtaggggtacgggttcggggtccgttacgggtacttaagtaaacgtcggggccccgtacggggtcgaacgaaacgtactaacttaaccgtcggacgaacggtacggtccggtggaccggtacggggcccagtcggaccacctactccgtaaccgaagaaccgtaactaaaccgttacccgaaacggtaaccggtaccgtaccgttacggtaacccgttagaacccgtaaagggtaccgaacgacggtaccgaaggaaccgaccggaccgaccgaccgtaccgggtaccttaattacgttacgtacggtaccgaaccgaacgtaaaacccgttcccggtaactaagttacgtacttcgaccgtttacggtacgggg

SEQ ID NO: 388677 - DNA, 717 bp, Homo sapiens
  misc_feature: GZ8MTXP02HT75N.11.67.G01.1.454.CMB.2.raw
  modified_base (182)..(182): a, c, t, g, unknown or other
  modified_base (218)..(218): a, c, t, g, unknown or other
  modified_base (237)..(237): a, c, t, g, unknown or other
  modified_base (240)..(240): a, c, t, g, unknown or other
  modified_base (268)..(268): a, c, t, g, unknown or other
  modified_base (340)..(340): a, c, t, g, unknown or other
  modified_base (456)..(456): a, c, t, g, unknown or other
tcagcgagagataccacgaccggtgctcgatttagagtatacatattggggtttgggggggttgagaagacaggactcaggacaatctccagcatggccagccttccctctcctcctccaccctcctcactcactgtgcagggtcctcgggcccagttctgttctgactcacgcccaccctnagtccgtcgtccggggacccccggagagactcaccnttctcttgtacagggaacncancctactaagtagtacggtaaagtaactntcgtactaagtgtacacactacgtcccggtacccccggaccgaccccctaactcctcactactaagtagacnccgccgacgcccggtacccgtcgggtaccggtccgtcggtacctacgttccgtcgtacggtctacggtaccgtcgtccgacctaccctcgacccgtcccgtcccggtacgtcccgnggtccgtacgggtccgtacctaccgtgtcgtaggtagtacggtcggtcgttacgttcgtttattagtttggttcgtacggtacggtacgggtagggttggggtagttcgggtcggtggtaggtggttcggtcggttacgggttcgggttcgggtacggggtaacggacgggtaccgtacgggtccgtaccggtccggtccggtcggacgaccggtaacccggcgtcccgtcccggtcccgttaccgtccgttcccgtcccg

SEQ ID NO: 388678 - DNA, 655 bp, Homo sapiens
  misc_feature: GZ8MTXP02G4I6B.11.67.G01.1.454.CMB.2.raw
  modified_base (176)..(176): a, c, t, g, unknown or other
  modified_base (211)..(211): a, c, t, g, unknown or other
  modified_base (226)..(226): a, c, t, g, unknown or other
  modified_base (253)..(253): a, c, t, g, unknown or other
  modified_base (359)..(359): a, c, t, g, unknown or other
  modified_base (465)..(465): a, c, t, g, unknown or other
  modified_base (528)..(528): a, c, t, g, unknown or other
  modified_base (573)..(573): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagcccacctnagcgtcgtcggggacccccggagagaactcaaccntctcttgactggaancagcctacaatcgtacggaagtaacgnttgtactaagttggtatacaactactcccgtaccccggtacccggaaccccctaactcctacaacttcaagtagaactcgaccgagccgaccctcggacgggtccncggacgtacttctgtcggctcggaaccgttcgtccggactacctcgacccgtcccttccggtccggtcgtcgcgtacggtcggtcctcggtagtcgtaggaacggntcgggagtcgtagtacttagttagtcggtcgtaacgtggtgggtaacggtgtaggtacggtgnggtaggtgtcgtagggtcgttcggtcggggacgggtaacggtacncggtaccggtcggtaccggttccggccggtagacccgtaacggccgtccgtccggccccggtcgtccgttacgtttaccccg

SEQ ID NO: 388679 - DNA, 728 bp, Homo sapiens
  misc_feature: GZ8MTXP02IY5F7.11.67.G01.1.454.CMB.2.raw
  modified_base (188)..(188): a, c, t, g, unknown or other
  modified_base (212)..(212): a, c, t, g, unknown or other
  modified_base (216)..(216): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctctcactcactgtgcagggtcctgggcccagtctgttctgactcacgccaccctnagcgtcgtcggggacccccggganaganaactccactattcttcgttacgtacgtaggacgcacgtacctaactaagtacggtaacggaaagtaacgtagtagtaactaagttgtaactacaaccgtacctcccggtaccccggtaaccccgacccctaaactcctactacttacgtaagtacggtaactaccgaccgcggtcccggcccgtacgggtaccggggtccgtcggtacccgtacttccgtacgtcggtacctacgtacgtccgtcgaccacccgtccgaccgtcccgtccgtcgaccgtcggcggtacggtcggtcctcgtacgtcgtaggtacggtagtacggtacgtacgttaacgttaatttagtttgtacggtcggtacgtagggtcgggtaggtacggttacggtaccggttagtagggttagttcggtcggtttcggggtccggggttcggtacggggacgggtaaccggacgtacggtccggtacggtcccggttacggtcgggacccgtaccggtaccgtacgg

SEQ ID NO: 388680 - DNA, 501 bp, Homo sapiens
  misc_feature: GZ8MTXP02FLCHT.11.67.G01.1.454.CMB.2.raw
  modified_base (463)..(463): a, c, t, g, unknown or other
  modified_base (485)..(501): a, c, t, g, unknown or other
tcagcgagagataccacgaccggtgctcgatttagagtatacatattgggtctcggctattaatggccacggtggcaagacatactacgcagagtccgtgcagggccgatgcaccatctccagagacaattccccagaagacgctgtacctgcaaaatggacagcctgagagccgacgacacggccgtatattactgtgccagaaatccgtccagatattgcactggtggcaactgctacgcgcctactattatacaccaacatggacgtcgtggggacgaaagggaccacggtcagtcgtctctcacgcctccacccaacggcccctactccggtccttccccctggaccccacccctccctccaagacgccacctcgtcggggcacgacgccgcccgtgggctacgccgttacggtcgaacggacttaccgttccgtacgtctctcgctcgaggtccgggngtcggcgaaggcgacagtagcnnnnnnnnnnnnnnnnn

SEQ ID NO: 388681 - DNA, 683 bp, Homo sapiens
  misc_feature: GZ8MTXP02JUOBP.11.67.G01.1.454.CMB.2.raw
  modified_base (328)..(328): a, c, t, g, unknown or other
tcagcgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggcttattttaaaaggtgtccagtgtgaggtggagttattgcgtagtcggtggggggggcttgggtgcaggccggagggggtccctgagactctcctgtgtaggctctggattctagttttgcagcctacgccatcgaccgtgggtcccgcgacggtccnccggaggggaaggggccgtgggaggttcggggtctccgggtattaagttaacgtcgggtaccccgacggggtagactaaaggactaagttaccgtacgccgaaaggtcggtaccgtgacgacggggtcccaagtcgacgacctactcctacgacgaacgacaacgttcccgaagaaacgaccggtctaaccggtactacgaacctaaagcgggaaccacggacccgttaggaacgaccggaccgtaaaccggaccgttaccggggaaccgttaattaacgttacgttacggtaccgacgtaaaacggtaccttccccggactaacgtagttacgttacacggtaccgtttagggg

SEQ ID NO: 388682 - DNA, 748 bp, Homo sapiens
  misc_feature: GZ8MTXP02IMK9U.11.67.G01.1.454.CMB.2.raw
  modified_base (174)..(174): a, c, t, g, unknown or other
  modified_base (222)..(222): a, c, t, g, unknown or other
  modified_base (247)..(247): a, c, t, g, unknown or other
  modified_base (711)..(711): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggccagtctgtctgactcagccaccctnagcgtcgtcggggaccccggagagaactcaccatctctgtactggaancagctacaatagtacggaataacgnttggtactaagttggtaactcgaactacgtcccgtaccccgggtaaccgccccctaaaacttccctactatcctaagtaacggtaactacgacccgacggacccgggtcccctcggaccgggggttcccccttcggggacccgtttattccgtccgtcgggtaccttacgggaaaccggtttccacggggtccctacccgtacgaccggtcccccttccgggtccgcccggttaggcccgttaacggggtcgggggccccttacccgggtaaagttccgagggtaacgggtacgttcgggaaccgggtctacgttaaacgttagttttaaccgtggttacgacggtaaagggtcccgggttaggggacgtttacggggtacgtacgtagggtcgtacggtcgttagggttgttcggtacgggacgggtacgggtacagtcggttacgaccgttcgacgggtacncggaacgacgtcctccgtcccgtcgtcgtaccttccg

SEQ ID NO: 388683 - DNA, 737 bp, Homo sapiens
  misc_feature: GZ8MTXP02IP400.11.67.G01.1.454.CMB.2.raw
  modified_base (176)..(176): a, c, t, g, unknown or other
  modified_base (198)..(198): a, c, t, g, unknown or other
  modified_base (225)..(225): a, c, t, g, unknown or other
  modified_base (252)..(252): a, c, t, g, unknown or other
  modified_base (268)..(268): a, c, t, g, unknown or other
  modified_base (309)..(309): a, c, t, g, unknown or other
  modified_base (511)..(511): a, c, t, g, unknown or other
tcagcgagagataccacgaccggtgctcgatttagagtatacatattggggtttgggggggttgagaagacaggactcaggacaatctccagcatggccagcttccctctcctcctcaccctcctcactcactgtgcagggtcctgggcccagtctgttctgactcagccaccctnagcgtcgtcggggacccccggnagagaatcaccatctcttgactggaancagcctacaatagtacggaaagtacgntgtactaagttggtanacaacactccgtaccccggtaccgacccccaaactccctanactctaagaggaatacgacctacggccggcccgtacggtaccgggggtccctcgggtccgtaacgtttccgtcgtacggtacgtacggtaaccggttctacgggtccctaacccgttcgaccggttccccctccgttcgggcctcggtacgtacgttcgggacctccgtagttcgaggacgagtggacgtcgtagtaacttntttaagtgtagacgagggtggtaggtagtaccgggtagggttccgtagggtggtcgttcggtcgggttcggttcccggttacgggggacggtaacccggggtaaacgacccgggtttcgaaacccgggttaccggttcccggggtcggttaacccgaccggtaaaaccccggcggtacccgtaccccgggtcccccgttaacggtccctttaacccgtttccccgg

SEQ ID NO: 388684 - DNA, 668 bp, Homo sapiens
  misc_feature: GZ8MTXP02JO5DT.11.67.G01.1.454.CMB.2.raw
  modified_base (194)..(194): a, c, t, g, unknown or other
  modified_base (229)..(229): a, c, t, g, unknown or other
  modified_base (318)..(318): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcaggtcctgggcccagtctgtctgactcagccacctcagcgtctggacccccgggagganaatccaccatctcttgtactggaagcagctcaatntcggaagtaacgctggtcaaagttggtaatcgaacatctaccccggtacgccccaaactcctacactctatagatagccaggacgtccncgacggggttccctggacctattcctctaggtctcgaacgtcgtggtcccaccgttcgaccggtccttccccgtacgggtccctaggcctaagggtcgggtacctccgtaacgtcgttcggaacgttacgttgaagggcttaacgggtacttaacggtttacttcgggttcgaccggttacgtaccgggtggttaacgttcgggccggtaacgttcggtaccgtaggttcccgtgggttaccggtcggtttcgggacgttacgggaccgtaagtccggtacggacccgttcgtacggttccgaacgtcccggtaaagtccgaccgtacccgtacggtctaccgtttccgg

SEQ ID NO: 388685 - DNA, 559 bp, Homo sapiens
  misc_feature: GZ8MTXP02J2NKQ.11.67.G01.1.454.CMB.2.raw
  modified_base (187)..(187): a, c, t, g, unknown or other
  modified_base (208)..(208): a, c, t, g, unknown or other
  modified_base (236)..(236): a, c, t, g, unknown or other
  modified_base (248)..(248): a, c, t, g, unknown or other
  modified_base (280)..(280): a, c, t, g, unknown or other
  modified_base (361)..(361): a, c, t, g, unknown or other
  modified_base (378)..(378): a, c, t, g, unknown or other
  modified_base (386)..(386): a, c, t, g, unknown or other
  modified_base (399)..(399): a, c, t, g, unknown or other
  modified_base (406)..(406): a, c, t, g, unknown or other
  modified_base (416)..(416): a, c, t, g, unknown or other
tcagcgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccacctnagcgtctcgggaccccccggnagagaatcaccatctcttgtactggaancagctacaatancggaataacgatgtcaaattggtatcaaactntccgtccccggtacgcccccaaactcctcatctatacggaatcgccagccggcctcgacggggtccctggccccgattccncgtggctacgagtccgngccacctnaccgccttcccgngcctgcngtcgctacgngtcgagagagtgacgtctagtactattgtgcgacgtagtcggtaggagtcggtacgtgtgtgtcgtcgttaggtcggttacggtcgggacggacggtaccgaggtccgtacggtaccgtcggtacggccgacggtaccgacgg

SEQ ID NO: 388686 - DNA, 776 bp, Homo sapiens
  misc_feature: GZ8MTXP02HBHSQ.11.67.G01.1.454.CMB.2.raw
  modified_base (197)..(197): a, c, t, g, unknown or other
  modified_base (254)..(254): a, c, t, g, unknown or other
  modified_base (258)..(258): a, c, t, g, unknown or other
  modified_base (320)..(320): a, c, t, g, unknown or other
tcagcgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagcccacctcagccgtcgtcggggacccccggnagagaatcaccatctcttgtacgtggaagcagctaccaatacgtacggaagtaacgntgtntaattggtatcaacatctccccggtaccgcccccaaactcctcagtctataggaatagaccncggaccggccctcgacggggtcccctggtccgatttctcgtcggacttcggaaccgtcgttacggctaacccgtcgtaaccgcccgttcccccgtcggtcccgtcgtaaccgtagtcgggggtaccgttccccaaggttcccgtagtaccggggtaaagtggtacgggacgttaccggtacttagttttaaagttcggtaagtacgttccggaacgggttagggggtcgtttaacggtaccggggttaccgtacgggttacgtttgggggtcccgtttggggtttccggggttttccggggttaacggggaccgggggttaacggggaacccgttaaacggtcgggtaaccgtacccggggtttccccgacgggggtacccgttaccggaaacccggacccgggtacccgttcccggccccccggtttccgtccccggttaaaacctttcccccgg

SEQ ID NO: 388687 - DNA, 499 bp, Homo sapiens
  misc_feature: GZ8MTXP01EM2DQ.51.28.C06.1.454.CMB.2.raw
  modified_base (475)..(475): a, c, t, g, unknown or other
tcagcgatcgtatacacgaccggtgctcgatttagagctcacgtattgggtttgggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttcctggtatcaacagaagccaggccagtcccctgtcgtggtcatctatcaagacaccaagcggccctcagggatccctgacgcgattctctggctccaactctgggaacacagccactctgaccatcagcgggacgcaggctgtggatgaggctggacttttactgtcaggcgtgggacagcgacactgccgtgttcggcgggggaccaagctgaccgttccttcggtcngccaggcttcgccccgttcggtcc

SEQ ID NO: 388688 - DNA, 509 bp, Homo sapiens
  misc_feature: GZ8MTXP01DPHMU.51.28.C06.1.454.CMB.2.raw
  modified_base (337)..(337): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaaagacaccaagcggccctcagggatccctgacgcgattcnctggctccaactctgggaaacacacgccactctgaccatcagcgggacgcgaggctgtggatgaggctgggacttttactgtcgaggcgtgggacagcgacactgccgtggtcgggcgggggacaagcgtgaccgttcttcggtcagcccaaggcttcgccccgttcggtcc

SEQ ID NO: 388689 - DNA, 525 bp, Homo sapiens
  misc_feature: GZ8MTXP01EDNZ5.51.28.C06.1.454.CMB.2.raw
  modified_base (457)..(457): a, c, t, g, unknown or other
  modified_base (511)..(511): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttctggtatcaacagaagccaggccagtcccctgtcgtggtcatctatcaagacaccaagccggcctcgaggactccctgacgcgtattctctcggccttcccaactcgtacggggaaaccacgacgccaactctacgaccagcgaggcgggacgcgaggctggtggatggagcttagggtacttttagtgtcgaggcgtggacagcgacncgtcgcggtggtcgggcgggggacagcgtcgcgttccgcggtcacgccgagccncgtccccgttgtcc

SEQ ID NO: 388690 - DNA, 512 bp, Homo sapiens
  misc_feature: GZ8MTXP01EEMW3.51.28.C06.1.454.CMB.2.raw
  modified_base (483)..(483): a, c, t, g, unknown or other
  modified_base (495)..(495): a, c, t, g, unknown or other
tcagcgatcgtatacacgaccggtgctcgatttagagctcacgtattgggtttgggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgagatagatatgttcctggtatcaacagaagccaaggccagtccccctgtcgtggtcatctatcaagacaccaagccggcctcgagggatcccctgacgcgattctctggctccaactctagggaaaccacacgccactctgaccatcagcgggacgcaggctgtgatgaggctgggtactttatgtcgaggcgtgggacagcgacacgtgccgtggttcggcgggggacagcgtgaccgttccgcggtcncgcccgaggccncgtccccgttcggtccg

SEQ ID NO: 388691 - DNA, 531 bp, Homo sapiens
  misc_feature: GZ8MTXP01D8PK6.51.28.C06.1.454.CMB.2.raw
  modified_base (512)..(512): a, c, t, g, unknown or other
tcagcgatcgtatacacgaccggtgctcgatttagagctcacgtattgggtttgggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccctgtcgtggtcatctatcaagacaccaagcggccctcagggatcccgtgacgcgattctctggcctccaactctagggaacacagccactctgaccatcagcgggacgcaggctgtggatgagctggtacttttactgtcaggcgtgggacgagcgacacgtcggccggtggttcggggcggggggaccaaggccgtggacccgttccgttcgggtccacggcccgaagggccncgtcccccgttcgggtccc

SEQ ID NO: 388692 - DNA, 562 bp, Homo sapiens
  misc_feature: GZ8MTXP01BEY1T.51.28.C06.1.454.CMB.2.raw
  modified_base (452)..(452): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgttcctggtatcaacagaagccaggccagtcccctgtcgtggtcatctatcaaagacaccaagcggccctgagggactcccgtgacgcgtattctcgtcggcctcccaactcgtagggaaaccacgacgcccactctacgaccatcaggcgggacgcgaggctggtggatggagctgggtacttttacgtgtcgaggtcgtgggacnggcgtacgactcggccggtgggttcggggcgggggaccgaagggcgtcggacccgttccgttccgggtcacggcccgaacgggcccttccggtcccccgttcggtaaccc

SEQ ID NO: 388693 - DNA, 552 bp, Homo sapiens
  misc_feature: GZ8MTXP01CPPPZ.51.28.C06.1.454.CMB.2.raw
  modified_base (439)..(439): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctctggggataaattgcgcgatagatatgtttcctggtatcaacagaagccaggccagtcccctgtcgtggtcatctatcaagactaccaagcggccctcgagggactccctgacgcgtattctcgtggacctccaactcgtacggggaaacacgacgcccaactctacgaccagtcgacggccgggacccaggctgtggatgaggtctagtacttttacgnggtcgagggcgtgggacaggcgactacgtgccggtggtcgggcgggggaccaggcgtacgccgttccgttcggttcaacgcccgaacggccgtccgccccgtcggttctcccg

SEQ ID NO: 388694 - DNA, 548 bp, Homo sapiens
  misc_feature: GZ8MTXP01DBBU0.51.28.C06.1.454.CMB.2.raw
  modified_base (252)..(252): a, c, t, g, unknown or other
  modified_base (338)..(338): a, c, t, g, unknown or other
  modified_base (408)..(408): a, c, t, g, unknown or other
  modified_base (429)..(429): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttccnggtatcaacagaagccaggccagtcccctgtcgtggtcatctatcaagacaccaagccgccctgaggactcccgtgacgcgattcncgtggcctaccaactcgtagggaaaccacacgccaactctcgaccatcgagcggacgcgaggctggtggntggagctgggtacttttacgngtcgaggtcgtaggacagcgtacacgtcgcccggtggtccggggcgggggaccaaggccgtcggacccgttccgcggtcaccggcccgaacggccgttccgtccccgttcggtaacccc

SEQ ID NO: 388695 - DNA, 511 bp, Homo sapiens
  misc_feature: GZ8MTXP01DENG1.51.28.C06.1.454.CMB.2.raw
  modified_base (396)..(396): a, c, t, g, unknown or other
  modified_base (486)..(486): a, c, t, g, unknown or other
  modified_base (495)..(495): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccctgtcgtggtcatctatcaagacaccaagcggccctcagggatccctgacgcgattctctggcctccaactctgggaaaccacacgccactctgaccatcagcgggacgcaggctgnggatgaggctgggtacttttacgtgttcgaggcgtgggacagcgacactgccgtggtcgggcgggggaccagctgaccgttcttcggtcncgccaggcncgtccccgttcggtcc

SEQ ID NO: 388696 - DNA, 521 bp, Homo sapiens
  misc_feature: GZ8MTXP01BX5KK.51.28.C06.1.454.CMB.2.raw
  modified_base (359)..(359): a, c, t, g, unknown or other
  modified_base (490)..(490): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgacgcgattctctggccttccaactctgggaacncagccactctgaccatcagcgggacgcaggctgtggatgaggctgggacttttactgtcaggcgtgggacagcgacactgccgtggttcgggcgggggaccgaaggcgtcggaccgttccgttcgggtccncggcccaggccttcgcccccgttcgggtccc

SEQ ID NO: 388697 - DNA, 557 bp, Homo sapiens
  misc_feature: GZ8MTXP01DAIWW.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcagccaccctccgtgtccgtgtccccaggacagacagccagcgtcacctgctcgtggggataaattgcgcgatagatatgttctggtatcaacagaagccaggccacgtcccctgtcgtggtcatctatcaagacaccaagccgcctcagggactcccgtgacgcgtattctctggcctccaactcgtacgggaacacgacgccactctcgaccatcgagcgggaacgcgaggctggtggagtgaggtctggttacttttagtcgtcgaggtcgtgggacgacgcgacgacgtcgtccggtcgggttcgggacgggggtaccgaacggccgtcgacccggttccgttcgggtccgacggcccgacggcgttccgtccccgttcggtcccg

SEQ ID NO: 388698 - DNA, 561 bp, Homo sapiens
  misc_feature: GZ8MTXP01APMOK.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggccctgagggactcccgtgacgcgattcgtctcggcctccaactcgtacgggaaccacgagtcccactctcgaccactcgacggcgggacgcgaggcgtggtggagtggagtctcgggtacttttacgtgtcgaggcggtcgggacgacggcgacgacgtcggtccggtgggttcgggcgggggaccgaaggccgtcggaccgttccgttcggcacggcccgaacggccttccggcccccgttcgggtccc

SEQ ID NO: 388699 - DNA, 539 bp, Homo sapiens
  misc_feature: GZ8MTXP01BV2WI.51.28.C06.1.454.CMB.2.raw
  modified_base (236)..(236): a, c, t, g, unknown or other
  modified_base (375)..(375): a, c, t, g, unknown or other
  modified_base (404)..(404): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgngatagatatgttctgtatcaacagagccaggccagtcccctgtcgtgtcatctatcaagacaccaagccggccctcgagggactccctgacgcgtattctctggcctaccaactcgtagggaaaccacacgcccactcncgaccatcgaggcgggacgcgaggctggngagtgaggtctgggtacttttacgtgtcgaggcgtggacagcgacacgtgccggtggtcggggacgggggacacggcgtcggaccgttccgttcggcgacggcccgaacgggccttccgtcccccgttcggtccc

SEQ ID NO: 388700 - DNA, 611 bp, Homo sapiens
  misc_feature: GZ8MTXP01D1UFR.51.28.C06.1.454.CMB.2.raw
  modified_base (242)..(242): a, c, t, g, unknown or other
  modified_base (249)..(249): a, c, t, g, unknown or other
  modified_base (256)..(256): a, c, t, g, unknown or other
  modified_base (260)..(260): a, c, t, g, unknown or other
  modified_base (467)..(467): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcacgccaccctccgtcgtccgtcgtccccaggacagacacgccagccgtcacctgctcgtagggataaattgcgnatagatnttgttcngtancaacagaacgccagccacgtcccctgtcgtgtcatctatacaaagaccaaccgaacggccgccctgacgggtactcccgtgacgcgtattctcgtcggtacctaccaacgtcgtacgggaaaccacgacgcctactccacgacctagcgacgggccgggaacgcgaggctgggtaggagtggaacgtcttacggtttacttttacgngttaccggagggtcggtacgggacgacggccgacgtacgtcggtccgggttcggggtaccgggggaccgggggacacgggtccgtcggacccgttcgttccggcgacccgccgacggtcccgttccggtcccccgttggtcccg

SEQ ID NO: 388701 - DNA, 526 bp, Homo sapiens
  misc_feature: GZ8MTXP01B8350.51.28.C06.1.454.CMB.2.raw
  modified_base (237)..(237): a, c, t, g, unknown or other
  modified_base (261)..(261): a, c, t, g, unknown or other
  modified_base (403)..(403): a, c, t, g, unknown or other
  modified_base (509)..(509): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagcccaccctccgtgtcccgtgtcccccaggacagacagccagcgtcacctgctctggggataaatgcgngatagatatgttcctggtatcaanagaagccaggccagtcccctgtcgtggtcatctatcaaagacaccaagccgcctcgaggactccctgacgcgattctctcggctcccaactcgtagggaacacagcccactctcgaccagtcaggcgggacgacgaggctgnggatgagcctggtacttttacgtgtcgaggcggtgggacgagcgacacgtggccggtggtcggggcgggggaccagcgtcgaccgttccgcggtcacgccaggccnccgtccccgttggtccc

SEQ ID NO: 388702 - DNA, 602 bp, Homo sapiens
  misc_feature: GZ8MTXP01C9625.51.28.C06.1.454.CMB.2.raw
  modified_base (241)..(241): a, c, t, g, unknown or other
  modified_base (264)..(264): a, c, t, g, unknown or other
  modified_base (334)..(334): a, c, t, g, unknown or other
tcagcgatcgtatacacgaccggtgctcgatttagagctcacgtattgggtttggggctgggcctcaggaagcagcatcggaggcgcctcagccatggcatggatccctctcttcctcggcgtccttgcttactgcacaggtatttgtggcctcctatgagctgactcacgcccaccctccgtgtccgtcgtccccaggacagacagccagcgtcacctgctcgtggggaataaattgcgngatagatatgttctgtatacaanagaacgccaaggccacgtcccctgtcgtggcatcatcaaagaccacaagccggcctcgagggactcccgngaacgcgtattcgtctggaccttaccaactcgtaaggggaaaccacgaagcccctaactctacgacccagtccgaggccggggacacgtagggcgtagagagtagagtacgttacggttacgttttacgttcgtacgtacggcggtacggacgacgacgtacgacgtcggtcgggtcgggtcggggacgggggaaccggaacggtacgtcgttaccggttccgttccggtcgaccgaaccgacggccgttccgtccccgttccgtccg

SEQ ID NO: 388703 - DNA, 658 bp, Homo sapiens
  misc_feature: GZ8MTXP01EHEOH.51.28.C06.1.454.CMB.2.raw
  modified_base (318)..(318): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtgggataaattgcgcgatagatatgttctgtatcaacagaagccaggccacgtcccctgtcgtgtcatctatcaagacaccaagcgcccagacgtacncgagcgctactctcgtcgtacctacctaacgtcggtaacgaaccacgaccgacctactctaccgaacctacgacgacgggaccggacgacggcggtcgtgggagtagtacgggacgttcgttaacggttttaaccgttttggtacgtacgggtacgggttacgggacggtacggacggaccgtaaccggtcggtcccgggtccggggttcggggtccggggggaccggggaaaccgttaaccgggtcgtaacccgggttaccccggttccggttcccgggaacgacccgggaacccggttccgggcccgttccccgggtccccgttccgggttaaccccg

SEQ ID NO: 388704 - DNA, 551 bp, Homo sapiens
  misc_feature: GZ8MTXP01ADR54.51.28.C06.1.454.CMB.2.raw
  modified_base (329)..(329): a, c, t, g, unknown or other
  modified_base (411)..(411): a, c, t, g, unknown or other
  modified_base (441)..(441): a, c, t, g, unknown or other
  modified_base (470)..(470): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttcctggtatacaacagaacgccaggccacgtcccctgtcgtggtcatctatacaagacaccaagccgcctgaggactccgngacgcgtattctctggacctccaacgttcgagggacacgacgccactcacgaccatcgacggcgggacgcgacggcgtaggnggagtggacggtcgtacggttactttacgngttacgagggtcggtggacacggcgaacncgtggccggtggtcggggcgggggaccaggtcgcgcccgttcgccggtcgcgcccgacggtccgccgtccccgttggtccc

SEQ ID NO: 388705 - DNA, 524 bp, Homo sapiens
  misc_feature: GZ8MTXP01BVZNJ.51.28.C06.1.454.CMB.2.raw
  modified_base (332)..(332): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgttcctggtatcaacagaagccaggccagtcccctgtcgtgtcatctatcaagacacaagcgcctgaggctccctgacgcgtattcnctggcctaccaacgtcgtacgggaaacacgacgcccactctgaccatcgagcgggacgcgaggctggtggatggaggtcttgggtaacttttacgtgtcgtaggcgtgggacacgcgacacgtcgcggtggtcgggcgggggacagcgtgcccgttcgcggtcacgccgaggcttccgtccccgttcggtcc

SEQ ID NO: 388706 - DNA, 598 bp, Homo sapiens
  misc_feature: GZ8MTXP01AO8BP.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttcctggtatcaacagagccaggccagtccccctgtcgtggtcatctatcaagacaccaagccggccctgaggactcccgtgacgcgtattcctcgtcggcctacccaactcgtacggggaaacacgacgacccactcctcgaccatcgaggccgggacgcgacggcgtggtaggagttggaaggtcgttagggttaccttttaacgtcggtaccgtaggtccggtgggacgacggcgacgacgttcgccgggtcggttccgggggccgggggtaaccaacgggccgtcggacccgttccgttccggtaacgaccgcccgaacggccgttccgtcccccgttccggtcccg

SEQ ID NO: 388707 - DNA, 622 bp, Homo sapiens
  misc_feature: GZ8MTXP01CA0RK.51.28.C06.1.454.CMB.2.raw
  modified_base (236)..(236): a, c, t, g, unknown or other
  modified_base (394)..(394): a, c, t, g, unknown or other
  modified_base (417)..(417): a, c, t, g, unknown or other
  modified_base (447)..(447): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgngatagatatgtttcctggtatcaaacagaacgccaggccacgtcccctgtcgtggtcatctatacaagaccacaagccgcctcgagggactcccgtgacgcgtattctctggccctaccaactcgtagggaaaccacacgcccaactctcgacctaancgaggccgggacgcgaggctggnggagtggagtcgttagggttacttttacgngttcgacgggtcggtacgggacgacggccgaacgtacgtcggtcccgggttgggttccgggggaccggggggtaaccaacggggtcccgtcgggttaccccggttcccgttaccgggtccgaccggtccccggaacgggtcccgttcccgggtccccccgttcgggttaaccccg

SEQ ID NO: 388708 - DNA, 609 bp, Homo sapiens
  misc_feature: GZ8MTXP01EZW3J.51.28.C06.1.454.CMB.2.raw
  modified_base (235)..(235): a, c, t, g, unknown or other
  modified_base (248)..(248): a, c, t, g, unknown or other
  modified_base (252)..(252): a, c, t, g, unknown or other
  modified_base (332)..(332): a, c, t, g, unknown or other
  modified_base (450)..(450): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtgggataaattgcgnatagatatgttcngtancaacagaacgccaggccacgtcccctgtcgtggtcatctatcaaacgaccaccaagccgccctgagggactccctggacncgtattcgtctcggcctaccaacttccgacggggaaacaccacgtcccaactcctacgaccatcgacggccgggaacgcgagggtctggaggatggacgtcttagggtacttttacgngtccgagggccgtagggacacggcgaccgtacgtcggccgggttgggttccgggggaccgggggacttaacgggccgtacggaccccggttccggccgggtaaccgaccggtaaccccggacgggtcccgttccccggtcccccggtttcggtcccccg

SEQ ID NO: 388709 - DNA, 702 bp, Homo sapiens
  misc_feature: GZ8MTXP01BFWUZ.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcacgccaccctccgtgtccgtcgtccccaggacagacagccagcgtcacctgctcgtggggataaattgcgcgatagatattcgtttcctggtatacaacagaacgccaggccacgtcccctgtcgtggtcatctatacaaacgaccaccgaagcccggtccctacgacgggactccccgtagacgcgtattcgtctcggaccctaccgaactcgtagggaaaccaccgacgccctaactcctacgacctagtacgaggaccgggacgacgacgggtctgggtaggagtggaacggtccgttaggggttaactttttacgtggtaccggtaagggtccggttaggggaccacgggccgtaaaccgtaccggttcgggtcccggggtttcggggttacccggggggacccggggggtaaaccaaacggggtccgttacgggaacccccggttcccggttacccggggttaaccgacccgggtaaccccgaacggggtcccgttaccccggtccccccggtttaacgggttcccccg

SEQ ID NO: 388710 - DNA, 566 bp, Homo sapiens
  misc_feature: GZ8MTXP01DHF98.51.28.C06.1.454.CMB.2.raw
  modified_base (409)..(409): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcagccaccctccgtgtccgtgtccccaggacagacagccagcgtcacctgctcgtggggataaattgcgcgatagatatgttcctggtatcaacagaagccaggccacgtcccctgtcgtggtcatctatacaagacaccaagccggcctcgagggactccctgacgcgtattctctggcctacaactcgtagggaaccacacgccactctcgaccatcgaggcgggacgcgaggcgtaggnggaactggaacggtctaggggttactttttacgtggtcgagggtcgtgggacaggcgacacggtcgtccgggtggttcgggggcgggggtacaggccgtgacccggttccttacgggtccacgcccgaacgggccttccggtccccgttcggttccc

SEQ ID NO: 388711 - DNA, 633 bp, Homo sapiens
  misc_feature: GZ8MTXP01EP7TQ.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcacgccaccctccgtgtccgtcgtccccaggacagacagccagcgtcacctgctcgtgggataaattgcgcgatagatatgtttcctggtatcaacagaacgccgaggccacgtcccctgtcgtggtcatctatcaagacaccaagccggcctcgagggactcccgtgacgcgtattcgctcggcctaccaacgtcgtacgggaacctacgacgacccactctacgacctagcgaggccgggacgacgagggtctgggtcggaagtggacgggttcttacggggttactttttacgtcggtcggaacgggtccggaggggacaacggtccgacgtaccggtcgggtcccgggtgggttaccgggggacggggggaacccttacgggtccgtaccgggttccccgttccggccgggtcccgacggccccgaagggtccccgttcccgtccccccgttcgggtccccg

SEQ ID NO: 388712 - DNA, 621 bp, Homo sapiens
  misc_feature: GZ8MTXP01CDHLK.51.28.C06.1.454.CMB.2.raw
  modified_base (236)..(236): a, c, t, g, unknown or other
  modified_base (397)..(397): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgngatagatattgttcctggtatcaacagaacgccacggccacgtcccctgtcgtgtcatctatacaagacaccaagccggccctcgagggactcccgtgaccgcgtattctctcggccttaccgaactcgtacgggaaaccacgacgccactctacgaccanacgacggacgggacgacgaggcgtggtaggagtggacggtcgttaggggttacttttacggtgttcggaagggtcgggtacggacgacggccgaccgtacggtcggtccgggttcgggttccgggggccggggggtaaaccacggtacccgttcggaccccggttccggttaccggtccgaccggaacccgaccggtccgttccggtcccccgttcgttccccg

SEQ ID NO: 388713 - DNA, 631 bp, Homo sapiens
  misc_feature: GZ8MTXP01CA5NO.51.28.C06.1.454.CMB.2.raw
  modified_base (498)..(498): a, c, t, g, unknown or other
  modified_base (508)..(508): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcacgccaccctcgtcgtccgtcgtccccaggacacgacagccagcgtcacctgctcgtaggggaataaagtgcgacgatagtattagttcgtttccgtaggtatacgaaacgaaggaacgccgaacggccctacgtccccgtgtcgtggtcctatcgtaataccgaaagaccaaccgaacggcccggacccgtacgaagggacctcccgtaggacccgtctacttctacgtcggtacctacccaacgttcgacgggaaaccacacgacctactcacgacagcgacggcggacgacgaggcgtggtgagtgagtcgttaggtacttttacgngtcgacgggngtacggacgacggcgactacgtcgtccgggtcgggtccggggacgggggacacggtccgtcgacccggttcgttccggaaccgaccgcccggtaacgcccgttccgtcccccgttcgtccccg

SEQ ID NO: 388714 - DNA, 543 bp, Homo sapiens
  misc_feature: GZ8MTXP01EA3WK.51.28.C06.1.454.CMB.2.raw
  modified_base (241)..(241): a, c, t, g, unknown or other
  modified_base (291)..(291): a, c, t, g, unknown or other
  modified_base (335)..(335): a, c, t, g, unknown or other
  modified_base (347)..(347): a, c, t, g, unknown or other
  modified_base (396)..(396): a, c, t, g, unknown or other
  modified_base (406)..(406): a, c, t, g, unknown or other
  modified_base (412)..(412): a, c, t, g, unknown or other
  modified_base (416)..(416): a, c, t, g, unknown or other
  modified_base (418)..(418): a, c, t, g, unknown or other
  modified_base (442)..(442): a, c, t, g, unknown or other
  modified_base (444)..(444): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcacgccaccctccgtgtccgtcgtccccaggaccagacagccagcgtcacctgctcgtaggggataaagtgcgngatagatattgttctggtatcaacagaacgccaggccagtcccctgtcgngtcatctatacaaagaccaccaagccgacctgagggactcccgngacgcgtattcnctcggaccctcaacgttcgacgggaaaccacgacgccacttcacgacancgagcgggancgagcngtgngngagcgtggtacttacgtgtgaggngnggacgagcgtacgacgtcgcggtcggttcgggcggggaccggaacgcgtcgccgttccgttccggtcgacgccgacggcgccgtcccgttccggtcccg

SEQ ID NO: 388715 - DNA, 527 bp, Homo sapiens
  misc_feature: GZ8MTXP01AGTUO.51.28.C06.1.454.CMB.2.raw
  modified_base (424)..(424): a, c, t, g, unknown or other
  modified_base (495)..(495): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccctgtcgtggtcatctatcaagacaccaagccgccctcgaggactccctgacgcgattctctggcctccaactcgtagggaaacacagccactctcgaccatcagcgggacgcgaggctgtggatggagtctaggtacttttacgngtcgaggcgtggacgagcgacacgtcgccggtggtcgggcgggggacaggcgtcgaccgttcgttcggtcncgcccgaaggccttccgtccccgttcggtccc

SEQ ID NO: 388716 - DNA, 597 bp, Homo sapiens
  misc_feature: GZ8MTXP01AZKRK.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctcgtgtccgtgtccccaggacagacagccagcgtcacctgctcgtggggataaattgcgcgatagatatgttctggtatcaacagaagccaggccacgtcccctgtcgtggtcatctatacaagaccaccgaagccggcctagacggactcccgtgaccgcgtattcgtcgtcggacctaccaacgtcgtacggggaaaccaccgacgcccacttctacgaaccatcgacggcgggacgacgaggcgtggtaggatggacgtcttacgggttacgttttacgcggttaccgaggtcggtagggacacggccgtacgacgtcggtccggtgggttcgggggacgggggacaacggcgtacggacccgttccgttcgggtccgaaccggcccgaaggcccgttccggtccccgttcggtaaccc

SEQ ID NO: 388717 - DNA, 580 bp, Homo sapiens
  misc_feature: GZ8MTXP01E257Y.51.28.C06.1.454.CMB.2.raw
  modified_base (249)..(249): a, c, t, g, unknown or other
  modified_base (294)..(294): a, c, t, g, unknown or other
  modified_base (312)..(312): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttcnggtatcaacagaagccaggccagtcccctgtcgtggtcatctaanacaagacacacgccgccngaggctccgtgaccgcgtatcgtcgtcgacctaccaacgtcgacggaaccacacgtccactcacgacctagtacgacgggccgggacgacgtacggtcgtcggtaggtacgtaggacggtacgttacgggttacgtttacgttacggtacggtacggtcggtacgggacgacgaccgtacgacgtcggtccgggtcgggtcggggacggggaccggacgcgtcgccgttccgttcgtcgacgccgacgccgccgtcccgttccgtccg

SEQ ID NO: 388718 - DNA, 606 bp, Homo sapiens
  misc_feature: GZ8MTXP01EMOMW.51.28.C06.1.454.CMB.2.raw
  modified_base (235)..(235): a, c, t, g, unknown or other
  modified_base (259)..(259): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcagccaccctccgtgtccgtgtccccaggacagacagccagcgtcacctgctctggggataaatgcgngatagatatgttcctggtatcaanagaagccaggccacgtcccctgtcgtggtcatctatcaaacgacaaccgaagccggacccctgacgggtactccccgtagacgccgtattcctcgtcggacccttaccaacgttccgtacggggaaaccacgacgacccaacttcgtacgaaccatacgacggccgggacgacgaggtcgtggtgagtgagtctggtactttacgtgtcgaggtcggtacggacgacgtcgacgtacggtccggtccggtcgggttccggggacggggggtacccaaggccgtcggacccgttccgttaccgggtccgacgcccgacggcccgttccggtcccccgttcggtccccg

SEQ ID NO: 388719 - DNA, 594 bp, Homo sapiens
  misc_feature: GZ8MTXP01DWVWM.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaagttgcgcgatagatatgtttcctggtatcaacagaacgccaaggccagtcccctgtcgtggtcatctatcaagacaccaagccggccctgacgggactcccgtgacgcgtattcctctggacctaccaactcgtacgggaaaccacacgcccaacgtcctacgaccatcgaggccgggaacgcgaggcgtggtggaagtggaggtccttaggttaacgttttacgtggtcgagggtcgtcgggacaggccgacgtaccgtggcccgggtggttccggggcgggggaccaaggtccgtcggacccgttccgttcccggtcgaaccgcccgaacggtcccgttccgtcccccgttcggttaacccg

SEQ ID NO: 388720 - DNA, 568 bp, Homo sapiens
  misc_feature: GZ8MTXP01ESW3C.51.28.C06.1.454.CMB.2.raw
  modified_base (418)..(418): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttcctggtatcaacagaagccaggccagtcccctgtcgtggtcatctatcaagacaccaagcggccctgagggactcccgtgaccgcgtattcgtctcggcctacccaacgtcgtagggaaaccacacgcccacgtctacgaccagtcgaggcgggacgacgaggtctggnggagtggagggtctaggggttacttttacgtgtacgagggcggtgggacacggtcgactacgtcggccggtggttcggggcgggggacaacggcgtcgacccgttcgttccggtcacggcccgagggccttccgtcccccgttcggtccc

SEQ ID NO: 388721 - DNA, 769 bp, Homo sapiens
  misc_feature: GZ8MTXP01ET1IY.51.28.C06.1.454.CMB.2.raw
  modified_base (239)..(239): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcacgccaccctccgtgtccgtcgtccccaggacagacagccagcgtcacctgctcgtaggggataattgcgngatagatattgttcctggtatacaacagaacgccaggccacgtcccctgtcgtgtcatctatacaagcagcaagccgcctacgaggtactcccgtaggacggtacgtacgttcctccgtacgggacccttcccgtaaacttcccgggtaaacggggaaaccccaccgaaccggtacccctaaccttccgtacggtaaccccagtaccggaacggggccgggggaaaccgcggttaacggggccggttagggtacgggtaagttacggggtaaccgggttcgtttaacgggttttaaaccggtttttttaaccgcgggttaaccgggttacgggggtaccggggttacggggaaacccgacgggtacccggaaaccgttccgggttacgggtaaccccggggtttacgggggttacccggggggaacccggggggttaaaccaaacggggtccgttacccgggttacccggttcccgttcgggaccgtcccggacccgacgggttcccctaaccccggttccccgttccgg

SEQ ID NO: 388722 - DNA, 848 bp, Homo sapiens
  misc_feature: GZ8MTXP01DY4SU.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtattttgtggcctcctatgagctgactcacgcccaccccgtccgtgtcccgtcgtccccaggacagacacgccacgcgtcacctgctcgtagggtaataaagttcgcgacagtagtattacgttcgtttccgtaggttactaccaaacgaacgaacgaccgacggccctaccgttcccccgtggttcggtcggtctacttactaactaccgaaacgaccgaaccgaacggcccggtaccccgttacggaacggggtaccttccccgtacggtaccggtaccgttacgttttccgtccgttccggtaaccccttacccgtaacccggttacgggtaaacccggggaaaacccaccgtaccgaccccgtaaccgttaccgtaccgaaccctacgtaccggaaccggggaccggggtaacccggaccgggtacgggtaccggtagggttacggggagtacggggtacggtttaccgtttacggggtttaaacgtttttccggtaggttacccgggtaggggtccgggttacgggaaccgaccgggtacgtaacccgtcgggtccggggtcccggggtttcggggtacccggggggaccgggggtaaacccgacgggtacccggttcccggttacccggttcccggttaccggtaacccgccggaacccggtaccggcccgttaccccggtccccggttcggttaaccccg

SEQ ID NO: 388723 - DNA, 684 bp, Homo sapiens
  misc_feature: GZ8MTXP01DS1B6.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcacgccaccctccgtcgtccgtcgtccccaggacagacagccagcgtcacctgctcgtagggataaagtcgcgcgatagatattgtttctggtatacaacagacgccgagccacgtcccctgtcgtgtcatcatacaaacgaccaccgaacggccggaccctcggaacgggtacctccgtgaccgccgtactttcgtacctcggcctaacccaacgtcgtacgggaaacccacaccgccctacgtactcactacgacgacgggcgggaccgcgaacgggtcgtgggaggagtacgggacggttccgttacgggtttaacgtttttaacggtcggtaccgggagggtccggtagggaccgtaaacggccgaacgtaccggttcgggtcccggggttgggttcccgggggacgggggaacccttaacgggtccgtccgggttaccccgttcgttaaccgggtcccgaaccggtccccggtacggtcccggttccccggttccccggttccgttccccgg

SEQ ID NO: 388724 - DNA, 562 bp, Homo sapiens
  misc_feature: GZ8MTXP01A4HMN.51.28.C06.1.454.CMB.2.raw
  modified_base (378)..(378): a, c, t, g, unknown or other
  modified_base (390)..(390): a, c, t, g, unknown or other
  modified_base (408)..(408): a, c, t, g, unknown or other
  modified_base (412)..(412): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccacctccgtgtccgtgtccccaggacagacagccagcgtcacctgctctgggataaattgcgcgatagatatgtttcctggtatcaacagaagccaaggccagtcccctgtcgtggtcatctatcaaagacaccaaagcggacccctacgagggtactccccgtgaacgccgattctctggaccttccaactcgtagggaacacaccncactcacgacancgaggcggacgacgtagngtgnggagagagtacgtacggtacgtttacgtgtacgacggcgtaggacgacgacgacgacgtcggcggtcggtcggggacggggaccggacgtacgtcgttaccgttccgttccggtaacgacgaaccgacgccgttccgtcccgttccgtcg

SEQ ID NO: 388725 - DNA, 594 bp, Homo sapiens
  misc_feature: GZ8MTXP01EKOGB.51.28.C06.1.454.CMB.2.raw
  modified_base (234)..(234): a, c, t, g, unknown or other
  modified_base (390)..(390): a, c, t, g, unknown or other
  modified_base (451)..(451): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataatgcgngatagatatgttctggtatcaacagagccaggccacgtcccctgtcgtgtcatctatacaagacaccgaagccgcctgacgggactcccgtgacgcgtattcctcgtcggacctaccaacgtcgtacgggaacacgacgccactctacgaccctancgacggcgggacgcgacggctggtagagtggaggtcttagggttacttttacgtgtacggngggtcggtacgggacgacggaccgaacgtccgtcgggcccgggttgggtccgggggaccgggggaaccaacggtcgtaaccgggcccgttccgcgggtaaccgaccggcccgacggcccgttccgtcccccgttcggtccccg

SEQ ID NO: 388726 - DNA, 844 bp, Homo sapiens
  misc_feature: GZ8MTXP01ES33X.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcacgccaccctccgtgtccgtgtccccaggacagacagccagcgtcacctgctcgtgggataaagtgcgcgatagattagttgtttcctggtactcaaacgagaacgccgaacggccacgtcccctggtcgtggtctatctactacaaacgaccaaccgaacggcccggtacccctacggacgggtaccttccccgagtaccggtccgttatttccgtacgttcggaacccttacccaacgtccgtaacggggaaaccctacgaccgtaccccacttaccgtacgtaacccacgttaccggaacggggcccggggtaaaccgcggtaaacggggtccgtggggtacgggttaacgtaggggtaaacggttccgtttacggggttttaaaccgtttttccggttacggttaaccgggcggggttaccgggggttaccggggaaaccggttacgggaccggtaaacccgttacgggtccggggttccccgggggtttcgggggttaccccggggggacccgggggggtaaacgttaaacccgggtcccgggttacccggttaaccccggggtttcccggtttaacccggggtaaccccggaaaccccgggtccccgggttaaacccggggtccccgttacccccgggtaacccccgggtttcccgggttttaacccccg

SEQ ID NO: 388727 - DNA, 577 bp, Homo sapiens
  misc_feature: GZ8MTXP01AVW4Q.51.28.C06.1.454.CMB.2.raw
  modified_base (357)..(357): a, c, t, g, unknown or other
  modified_base (461)..(461): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcacgccaccctccgtgtccgtcgtccccaggacagacagccagcgtcacctgctcgtggggataaagtgcgcgatagatatgttctggtatacaacagacgccaggccacgtcccctgtcgtggtcatctatacaagacagccaaacggccggtaccctagacgggtactcccgtagacgtcgtacttcncgtacggcctccaaacgtcgtacgggaaccacgacgacccactctacgaccagtcgacggcggacgcgaggctggagagtggaggtcgttagttacttttacgngtacgaggtcggtagggacgacggtccgacgtacgtcggtccggtagggttccgggggaccggggaccaaggcgttcgcccgttcgtcgtcaacgccgacggcctcgccccgttcg

SEQ ID NO: 388728 - DNA, 535 bp, Homo sapiens
  misc_feature: GZ8MTXP01EYEX4.51.28.C06.1.454.CMB.2.raw
  modified_base (385)..(385): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttctggtatacaacagaacgccaggccacgtcccctgtccgtggtcatctatcaagacacaagccggcctcgaggactccctgacgcgtatctctggacctaccaactcagggaacacacgtaccactcgtagaccancgacgcggacgcgacggtcgaggaggagtgagtcgtcggttactttacgttcgtacgacggcggtcggacgacgacgacgacgtcgtcggtcggtcgggcggggacggacgcgtcgcgttcgcgtcgcgccgcgcgccgtcccgccgtcg

SEQ ID NO: 388729 - DNA, 639 bp, Homo sapiens
  misc_feature: GZ8MTXP01B4NSL.51.28.C06.1.454.CMB.2.raw
  modified_base (233)..(233): a, c, t, g, unknown or other
  modified_base (245)..(245): a, c, t, g, unknown or other
  modified_base (358)..(358): a, c, t, g, unknown or other
  modified_base (422)..(422): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctctatgagctgactcagccaccctccgtgtccgtgtccccaggacagacagccagcgtcacctgctcgtgggataaatgcgnatgatatgttcnggtatcaacagagccaaggccagtcccctgtcgtggtcacgtctaatacaaagacaaccaacggcggcctagagggactcccgtgaccgcgattctacgtggccttacaactntacggggaacaccaacgtccactacgttacgaaccaagcgacgggacgggaacgcgtaacgggngttaggaggttaacggtggtacgttacgttacggtttaacgtttacgtcggtacggaggtcgggtacggtaccgacggtaccgtaaccgtacgttcgggtaccggttcggggtaccgggggaccggggtaaccacggtccgtaccgttcccggttcgttacccgggtaaccaccggtaacccgtacggtcccgttaccccgtccccgttccggtccg

SEQ ID NO: 388730 - DNA, 576 bp, Homo sapiens
  misc_feature: GZ8MTXP01DTVBI.51.28.C06.1.454.CMB.2.raw
  modified_base (325)..(325): a, c, t, g, unknown or other
  modified_base (438)..(438): a, c, t, g, unknown or other
tcagcgatcgtatacacgaccggtgctcgatttagagctcacgtattgggtttggggctggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgttctggtatcaacagaagccaggccacgtcccctgtcgtggtcatctatcaagaccacaagccgcctgaggctcccgngacgcgattctctggcctaccaactcgtacgggaacacgacgcccactcctacgaccatcgacggtcgggacgcgacggctggtggagtaggaggctagggtacttttaacgngttacgaggcggtgggacaggcgacgacgtcggcggtcggtcggggacgggggacaacgggtcgtacggacccggttccgttccggtaacgaccggccccggtaacggcccgttaccggtcccccgttaacggtcccg

SEQ ID NO: 388731 - DNA, 504 bp, Homo sapiens
  misc_feature: GZ8MTXP02I8MPN.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgacgcgattctctggctccactctgggaacacagccactctgaccatcagcgggacgcaggctgtggatgaggctgacttttactgtcaggcgtgggacagcgacactgccgtgttcgggcgggggaccaaggcgtcgaccgtccgtcggtcgacgcccaacggctcgcccctcggtcc

SEQ ID NO: 388732 - DNA, 549 bp, Homo sapiens
  misc_feature: GZ8MTXP02H7XPL.51.28.C06.1.454.CMB.2.raw
  modified_base (339)..(339): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccctgtcgtggtcatctatcaagacaccaagcggccctcaggggactccctgacgcgattcnctggctccactctgggacacagccatctgaccatcgaggcgggacgcgaggctgtggatggaggctagttacttttagtgtcgagggcgtagggacagacgacgacgtcgccggttcggttccgggggaccgggggaccgaaggccgtacggacccgttccgtaccggtcgaccgacccgaacggcctcccggtccccgtccggtacccg

SEQ ID NO: 388733 - DNA, 496 bp, Homo sapiens
  misc_feature: GZ8MTXP02FVGAE.51.28.C06.1.454.CMB.2.raw
  modified_base (423)..(423): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgacgcgattctctggctccactctgggaacacagccactctgaccatcagcgggacgcaggctgtgatgaggctgactttactgtcaggcgtgggacngcgacactgccgtgttcggcgggggacaaggctcgaccgtcctcggtcacgcccaaggctcgcccctcggtcc

SEQ ID NO: 388734 - DNA, 507 bp, Homo sapiens
  misc_feature: GZ8MTXP02JKAQ5.51.28.C06.1.454.CMB.2.raw
  modified_base (425)..(425): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgacgcgattctctggctccactcgtgggaacacacgccactctgaccatcagcgggacgcaggctgtgatgaggctgtactttatgtgaggcggtggacngcgacacgtgccggtcggtcgggcgggggaccaggctcgaccgtcgtcggcgacgcccgacggcgtccgccccgtcggtccg

SEQ ID NO: 388735 - DNA, 527 bp, Homo sapiens
  misc_feature: GZ8MTXP02J2MFT.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggccctcaggggactcccgtgacgcgattctctggctccactctgggaacacagccactctgaccatcagcgggacgcgaggctgtggatgagggctggacttttacgtgttcgagggcgtggggacaggcgacacgtggccggttggttccgggcgggggaccaggcgtcgaccgtccgtcggtcacggcccgacggcctccgcccccgtcggtccc

SEQ ID NO: 388736 - DNA, 509 bp, Homo sapiens
  misc_feature: GZ8MTXP02GT7GI.51.28.C06.1.454.CMB.2.raw
  modified_base (399)..(399): a, c, t, g, unknown or other
  modified_base (409)..(409): a, c, t, g, unknown or other
  modified_base (423)..(423): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggactccctgacgcgattctctggcctccactctggggaacacagccactctgaccatcagcggacgcaggctgtgatgagntgtactttangtcgagcgtggacngcgacactcgccggtgttcggggcggggaccgaaggcgtacgcccgtcgtccggtcgacgcccgaaggcctcgccccgtcggtccc

SEQ ID NO: 388737 - DNA, 473 bp, Homo sapiens
  misc_feature: GZ8MTXP02J5OZQ.51.28.C06.1.454.CMB.2.raw
  modified_base (252)..(252): a, c, t, g, unknown or other
  modified_base (255)..(255): a, c, t, g, unknown or other
  modified_base (259)..(259): a, c, t, g, unknown or other
  modified_base (264)..(264): a, c, t, g, unknown or other
  modified_base (284)..(284): a, c, t, g, unknown or other
  modified_base (289)..(289): a, c, t, g, unknown or other
  modified_base (296)..(296): a, c, t, g, unknown or other
  modified_base (313)..(313): a, c, t, g, unknown or other
  modified_base (322)..(322): a, c, t, g, unknown or other
  modified_base (324)..(324): a, c, t, g, unknown or other
  modified_base (326)..(326): a, c, t, g, unknown or other
  modified_base (331)..(331): a, c, t, g, unknown or other
  modified_base (342)..(342): a, c, t, g, unknown or other
  modified_base (346)..(346): a, c, t, g, unknown or other
  modified_base (348)..(348): a, c, t, g, unknown or other
  modified_base (350)..(350): a, c, t, g, unknown or other
  modified_base (352)..(352): a, c, t, g, unknown or other
  modified_base (356)..(356): a, c, t, g, unknown or other
  modified_base (367)..(367): a, c, t, g, unknown or other
  modified_base (369)..(369): a, c, t, g, unknown or other
  modified_base (371)..(371): a, c, t, g, unknown or other
  modified_base (379)..(379): a, c, t, g, unknown or other
  modified_base (381)..(381): a, c, t, g, unknown or other
  modified_base (399)..(399): a, c, t, g, unknown or other
  modified_base (403)..(403): a, c, t, g, unknown or other
  modified_base (455)..(455): a, c, t, g, unknown or other
tcagcgatcgtatacacgaccggtgctcgatttagagctcacgtattgggtttgggctgggcctcaggaagcagcatcggaggtgcctcagccatggcatggatccctctcttcctcggcgtccttgcttactgcacaggatttgtggcctcctatgagctgactcacgccaccctccgtgtccgtgtcccaggacagacagccagcgtcacctgctcgtaggggataattgcgcgatagatatgtttccgngtnacanagacncgcgctcctccgtgtgtcanatcanagacacncgagccgctgagctcgngctctctcncncnctacncgtcgacgacncacncncncncacngcgcgcggcgngngngtgtgagngngtcgtcgtacgtcgtcgngcgnggcgacgacgcgcgtcgcgtcggtcggtcggcgacgcgcgcgcgcgcgcgcncgacgcgcgccgccgtcg

SEQ ID NO: 388738 - DNA, 547 bp, Homo sapiens
  misc_feature: GZ8MTXP02H4Z9D.51.28.C06.1.454.CMB.2.raw
  modified_base (314)..(314): a, c, t, g, unknown or other
  modified_base (423)..(423): a, c, t, g, unknown or other
  modified_base (430)..(430): a, c, t, g, unknown or other
tcagcgatcgtatacacgaccggtgctcgatttagagctcacgtattgggtttgggctgggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctctggggataaattgcgcgatagatatgttcctggtatcaacagaagccaggccagtcccctgtcgtggtcatctatcaagacaccaagccggcctnaggggatccctgacgcgattctctggctccatcctagggaaccacgagccactctacgaccatcaggcgggacgcgaggctggtggatggaggctggtactttttacgnggtacgngggtcgtgggacaggacgacgacgtcggccggttggttccgggggcgggggaccaaaggcgtacggaccgtccgtcggtcgacgacccgaacggccgtccggcccccgtacggtccc

SEQ ID NO: 388739 - DNA, 521 bp, Homo sapiens
  misc_feature: GZ8MTXP02GX9EB.51.28.C06.1.454.CMB.2.raw
  modified_base (418)..(418): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggcccagtccccctgtcgtggtcatctatcaagacacaagcggccctcgagggactccctgacgcgattctctggcctccactcgtagggaaacacagcccactctgaccatcagcgggacgcaggctggtgatggagctgtactttagngtcgaggcgtagggacagcgacacgtcgccggtcggtcggggcggggaccaggccgtcgacccgtccgtcggcacgacccgaggcctcgccccgtcggtaccc

SEQ ID NO: 388740 - DNA, 587 bp, Homo sapiens
  misc_feature: GZ8MTXP02IHUB4.51.28.C06.1.454.CMB.2.raw
  modified_base (338)..(338): a, c, t, g, unknown or other
  modified_base (417)..(417): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataattgcgcgatagatatgtttcctggtatcaacagaagccaggccagtccccctgtcgtgtcatctatcaagacaccaagccggcctcgagggactcccgtgacgcgattcnctggcctccactcgtagggaacaccagccactctgacatcagcggacgcgaggctgtgatgaggtctgtacttttacgngtcgagggccggtagggacacggacgaactccggtcggtcccggttacgggttccgggggaccggggggaacctaaacgggaccgttccggggaaccccgtttcccgccggggttaaccaaccggaccccgaaacgggtccctacccggtccccccgttacgggtccccg

SEQ ID NO: 388741 - DNA, 718 bp, Homo sapiens
  misc_feature: GZ8MTXP02JPTP4.51.28.C06.1.454.CMB.2.raw
  modified_base (254)..(254): a, c, t, g, unknown or other
  modified_base (298)..(298): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgcccaccctccgtgtcccgtgtccccaggacagacagccagcgtcacctgctcgtgggataaagtgcgcgatagattatgttccnggtatacaacagacgccaggccacgtcccctgtcgtgtcatcanacaagaccacgaacgccgcctgacggtactcccgtgaccgtcgtattcctcgtcggcctaccacgttcgacgggaaccaccgacgaccctacttcgacgaaccctagtaccgaacgggccgggaaccgccgtagggtccgttggggtacggagttagggtacggttccgtttaacggttaaccgtttttcggacgggttacgggaacggggtccgggttacggggaaccgtacgggacccgtaacccggttacggttccggggacccggggtttcgggggttaccccgggggaccgggggttaaacccaacggtcccgggttaaccgggtacccccggtttccggtaaccgggtccgaaccccggttaccccggaaccggtccccgtacccccggtcccccggttacgggtttacccccg

SEQ ID NO: 388742 - DNA, 511 bp, Homo sapiens
  misc_feature: GZ8MTXP02JG3XI.51.28.C06.1.454.CMB.2.raw
  modified_base (260)..(260): a, c, t, g, unknown or other
  modified_base (415)..(415): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaanagaagccaggccagtcccctgtcgtggtcatctatcaagacaccaagcgccctcagggactccctgacgcgtattctctggctccactctgggaaacacagccactctgaccatcagcgggagcaggctgtggatggaggctaggtactttacgngtcgaggcgtggacagcgacacgtgcgtgtcgggcgggggaccaggcgtcgacccgtcgtacggtcacgcccgacggcctacgccccgtcggtccc

SEQ ID NO: 388743 - DNA, 568 bp, Homo sapiens
  misc_feature: GZ8MTXP02JCAAI.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttcctggtatcaaacagaagccaggccagtcccctgtcgtggtcatctatcaagacaaccaagccggccctcgagggactccccgtgacgcgattctcgtggcctccactcgtagggaaacacagcccactctagaccatcgagcgggacgcgaggctgtggatgagggcttaggtacttttacgaggttcgagggtcggtggggacagggaccgacacgtcggcccggttgggttccgggggccgggggaaccaaggccgtacggacccgtccgtccgggcgaccggtacccgacgggtcctccggcccccgtcggtccc

SEQ ID NO: 388744 - DNA, 594 bp, Homo sapiens
  misc_feature: GZ8MTXP02HL8QV.51.28.C06.1.454.CMB.2.raw
  modified_base (259)..(259): a, c, t, g, unknown or other
  modified_base (398)..(398): a, c, t, g, unknown or other
  modified_base (437)..(437): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgttctggtatcaanagacgccagccacgtcccctgtcgtggtcatctatacaagacaccaagccggccctcgagggactcccgtgacgcgtattctctggcctaccactcgtacggaacacgacgcccactcacgaccatcgacggcgggacncgaggctggtggatggacggtcttagttactttttacgngtcgagggtcggtacgggacaggacgacgtacgtcggtccggttcgggtaccgggggaccgggggaaccaggtccgtacggtacccggttcccgttcggggtaacccaccgggaccccgtaacggtcccgtcccggtccccccggttcggtaccccg

SEQ ID NO: 388745 - DNA, 585 bp, Homo sapiens
  misc_feature: GZ8MTXP02G7C1E.51.28.C06.1.454.CMB.2.raw
  modified_base (496)..(496): a, c, t, g, unknown or other
tcagcgatcgtatacacgaccggtgctcgatttagagctcacgtattgggtttggggctgggccccaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatattgtttcctggtatcaaacagaagccaaggccacgtccccctgtcgtggtcatctatcaaagacaaccaagccggcccctagacgggtactccccgtagacgccgtactttccgtcgtcggccttaccgaaacttccgtacgggaaaccacgacgccctaactcctacgaacccatacgaaggccggggacgcgaggctggtggatggacggtctgttacttttactgtcgagggcgtgggacaggcgaacncgtcgcgtggttcggggacggggacaacggcgacggtaccgtccgtcggacgaacggcccgaacggcctcgcccccgtcggacctaccg

SEQ ID NO: 388746 - DNA, 558 bp, Homo sapiens
  misc_feature: GZ8MTXP02IXEJU.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccctgtcgtggtcatctatcaagacaccaagccggccctcgagggactccctgacgcgattctctggcctccactctagggaacacagccactctcgaccatcaggcgggacgcagggctggtggatggaggtcttaggtactttttacgtcgttcgagggacggttgggacgaggcgaccgtacgtcggcccggttcgggttcggggaccggggggaccgaaggccgtcgacccgtccgtcggtcgacggcccgacggccgtcggcccccgtcggtcccg

SEQ ID NO: 388747 - DNA, 560 bp, Homo sapiens
  misc_feature: GZ8MTXP02HH6GU.51.28.C06.1.454.CMB.2.raw
  modified_base (424)..(424): a, c, t, g, unknown or other
  modified_base (437)..(437): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttcctggtatcaacagaagccaggccagtcccctgtcgtggtcatctatacaagacaaccgaaggccgccctcgagggactcccgtgacgcgtattctcgtcggacctaccactcgtagggaaaccacacgacccactctacgaccactcgaggcggacgcgaggctggtgatgagntagtacttttacnggtacgaggtcggtggacgagacgactacgtcgccggtcggttccgggggacgggggaccgaaggcgtcgaccggtccgtccggtcgacggcccgaacgccgtcccggccccgttcggtcccg

SEQ ID NO: 388748 - DNA, 502 bp, Homo sapiens
  misc_feature: GZ8MTXP02IUC8F.51.28.C06.1.454.CMB.2.raw
  modified_base (408)..(408): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttcctggtatcaacagagccaggccagtcccctgtcgtggtcatctatcaagacaccaagcggccctcaggatccctgacgcgattctctggctccactctgggaacacagccactctgaccatcaggcgggacgcgaggctgtggatgaggctgacttttangtcgaggcgtgggacagcgacactgccgtggtcgggcgggggacaaggctcgaccgtccgtcggtcgacgcccgacggctccgcccctcggtcc

SEQ ID NO: 388749 - DNA, 527 bp, Homo sapiens
  misc_feature: GZ8MTXP02GM4V7.51.28.C06.1.454.CMB.2.raw
  modified_base (359)..(359): a, c, t, g, unknown or other
  modified_base (419)..(419): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggcctcagggatccctgacgcgattctctggcctccactctggggaaacncagccactctgaccatcaggcgggacgcgaggctggtggatggaggtctgtacttttacnggtccgagggccgtggggacaggcgacacgtgccggtggttccggggcgggggaccaaggcgtacgccgtccgtcggtcgacgcccgacggcctcgcccctcggtccc

SEQ ID NO: 388750 - DNA, 503 bp, Homo sapiens
  misc_feature: GZ8MTXP02HFBLI.51.28.C06.1.454.CMB.2.raw
  modified_base (357)..(357): a, c, t, g, unknown or other
  modified_base (409)..(409): a, c, t, g, unknown or other
  modified_base (424)..(424): a, c, t, g, unknown or other
  modified_base (488)..(488): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttcctggtatcaacagaagccaggccagtcccctgtcgtggtcatctatcaagacaccaagcggccctcagggatccctgacgcgattctctggctccactctgggaaccanagccactctgaccatcagcgggacgcaggctgtggatgaggctgacttttangtcaggcgtgggacngcgacacgtgccgtgtcgggcgggggaccaagcgtcgaccgtccgtcggtcgacgccgaggccncgccccgtcggtccc

SEQ ID NO: 388751 - DNA, 557 bp, Homo sapiens
  misc_feature: GZ8MTXP02JYUF1.51.28.C06.1.454.CMB.2.raw
  modified_base (408)..(408): a, c, t, g, unknown or other
  modified_base (434)..(434): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcatctgctcgtggggataaattgcgcgatagatatgttcctggtatcaacagagccaggccagtcccctgtcgtggtcatctatcaagacaccaagccggccctcgagggactccctgacgcgtattctcgtcggcctccaactcgtacgggaacacgacgccactctcgaccatcgacggcgggacgcgaggctggngagtggaggtcttagtacttttacgngtcgaggcggtagggacacgcgactacgtcggccggttgggtaccgggggcgggggaaccaacggtccgtcggtacccgtccgtcggtccgacggacccgtacggccgtccggcccccgtcgg

SEQ ID NO: 388752 - DNA, 548 bp, Homo sapiens
  misc_feature: GZ8MTXP02I9EEE.51.28.C06.1.454.CMB.2.raw
  modified_base (327)..(327): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtcgtccccaggacagacagccagcgtcacctgctcgtggggaataaattgcgcgatagatattgtttcctggtatcaacagaacgccgaggccacgtcccctgtcgtgtcatctatcaagacacagcgcctgaggactccgngacgcgtattctctcggcctaccactcgtacgggaaaccacgacgacccactctacgacctatcgaggccgggacgcgacggcgtggtggatggaggtcttagtacttttacgtgtacgagggcgtagggacaggacgacacgtcgcggttcggtcggggcggggtacaaggcgtcgaccgtccgtcggtcgacgaccgacggcctccgcccgtcggtccc

SEQ ID NO: 388753 - DNA, 734 bp, Homo sapiens
  misc_feature: GZ8MTXP02IVNHH.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcttcacctgctctggggataaattgcgcgatagatatgttcctggtatcaacagaagccaggcccagtcccctgtcgtggcatctatcaagacaccaagcgcctcaggactccctgacgcgatttcctcgtcggcctacccacgttcgtacggggaaaccacgaaccgaccctaaccttcctacgaccctaaatcccgaaacggccggggaaccgacgacgggaccgttggtgggtaattgggaaagggtccgttacgggtaaccttttttaacgtcggtttaccgggaagggtcccgggttaggggaaccgacggtaaccgggtaccaaccggttcggggtacccccgggttagggggtttccccggggggaccggggggggggtaaaccccaaaacggggtacccggttccgggtaaacccccgggttccccggttttccggggtaacccgaaccccgggtacccccggaaaacggggtccccgttacccccgggtaccccccccgttccggggtttaacccccg

SEQ ID NO: 388754 - DNA, 501 bp, Homo sapiens
  misc_feature: GZ8MTXP02GT7DG.51.28.C06.1.454.CMB.2.raw
  modified_base (315)..(315): a, c, t, g, unknown or other
  modified_base (336)..(336): a, c, t, g, unknown or other
  modified_base (410)..(410): a, c, t, g, unknown or other
  modified_base (425)..(425): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctnagggatccctgacgcgattcnctggctccactctagggaacacagccatctgaccatcagcggacgcgaggctgtggatgaggctgtactttacngtcaggcgtgggacngcgacacgtgccgtggtcggcgggggacaggctcgaccgtccgcgtcgacgcccgacggctcgccccgtcggtccg

SEQ ID NO: 388755 - DNA, 517 bp, Homo sapiens
  misc_feature: GZ8MTXP02GDOH5.51.28.C06.1.454.CMB.2.raw
  modified_base (418)..(418): a, c, t, g, unknown or other
  modified_base (501)..(501): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggaccagacagccagcgtcacctgctcgtggggataaattgcgcgatagatatgtttcctggtatcaacagaagccaggccagtcccctgtcgtgtcatctatcaagacacaagccggcctcgaggatccccgtgacgcgattctacgtggcttccactcgtacgggaacacacgccactctacgaccatcagcggacgcagctgtgatgaggctgtactttacngtcgaggcgtggacgagcgacacgtgcggtcggtcgggcggggaccaaggcgtcgaccgtcgtccggcgacgcccgaacgccnccgcccccgtcggtcc

SEQ ID NO: 388756 - DNA, 527 bp, Homo sapiens
  misc_feature: GZ8MTXP02G46MK.51.28.C06.1.454.CMB.2.raw
  modified_base (422)..(422): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggccctcgagggactccccgtgacgcgattctctggctaccactctagggaacacacgccactctcgaccatcaggcgggacgcaggctgtggatgaggctgtacttttacgngtcgaggcgtgggacaggcgacgacgtgccggtggttcggggcgggggaccaggcgtcgaccgtccgtcggtcgcgacccgacggcctccgcccccgtcggtccc

SEQ ID NO: 388757 - DNA, 600 bp, Homo sapiens
  misc_feature: GZ8MTXP02GEGLZ.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtgggataaatgcgcgatagatatgtttcctggtatacaacagaagccaggccacgtcccctgtcgtgtcatctatcaagcaaccaagccggccctagacgggactccccgtagacgtccgtatttccgtcgtacggtccctaccctaacgtccgtacggggaaacctaccgacgaccctactctacgacccatcgacggcgggacgcgaggcgtggtggatcgaggtacgtagttacgtttacgtgtacggaaggtcgtagggactacgacgacacgtcgccggtcggttccgggggaccgggggacctaaaggccgtacgacccggttccgttccggaaccgaccggacccgacggccgttaccgcccccgtaggtccc

SEQ ID NO: 388758 - DNA, 567 bp, Homo sapiens
  misc_feature: GZ8MTXP02I1218.51.28.C06.1.454.CMB.2.raw
  modified_base (341)..(341): a, c, t, g, unknown or other
  modified_base (397)..(397): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgttcctggtatcaacagaagccaggccagtcccctgtcgtggtcatctatcaagaccaccaagcggaccctcaggggactcccgtgacgcgattcnctcggcctaccactcgtacgggaaacacagcccactctacgaccatcaggcggacncgaggctggtgagtgaggctgtactttagtgtcgagggtccgtgggacacggacgactacgtcgccggttcggttcggggaccgggggaccaaacggtccggtacgaacccggtcccgtacgggtaaccacggacccgtaaacggcccgtccgacccccgtacggtcccg

SEQ ID NO: 388759 - DNA, 666 bp, Homo sapiens
  misc_feature: GZ8MTXP02ISMQA.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttcctggtatcaacagaagccaggccagtcccctgtcgtgtcatctatcaagacaccaagccgcctcgagggactccctgacgcgattctctggcctaccactcgtacgggaacacgacgccactctcgaccatccgaaggccgggacgcgacggtctaggtcgggagtcgggacggtaccgtttaggttaacccgttttttacgtcggttacgtaacggggtccggggttacgggggaacacgggtaccggaaccgtaaccggtcgggtcccggggtttcggggttacccggggggacccggggggtaaaccaaacggggtccggtaccggtaaccccgggtttcccgtaccggggttaaccgacccggtaccccggtaacgggtcccgtacccccggtcccccggtttcggtacccccg

SEQ ID NO: 388760 - DNA, 506 bp, Homo sapiens
  misc_feature: GZ8MTXP02JZES2.51.28.C06.1.454.CMB.2.raw
  modified_base (359)..(359): a, c, t, g, unknown or other
  modified_base (384)..(384): a, c, t, g, unknown or other
  modified_base (413)..(413): a, c, t, g, unknown or other
  modified_base (476)..(476): a, c, t, g, unknown or other
  modified_base (493)..(493): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggcctcagggatcccctgacgcgattctctggcctcactctagggaaccncagcactctgaccatcagcgggacnaggctgtgatgaggctaggtactttttangttcagggcgtaggggacaggcgacactgcccgtgtcgggcgggggacaaggcgcgaccgtcncggtcacgccgaggccncgcccctggtccc

SEQ ID NO: 388761 - DNA, 543 bp, Homo sapiens
  misc_feature: GZ8MTXP02HVJKU.51.28.C06.1.454.CMB.2.raw
  modified_base (412)..(412): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcaacccaccctccgtgtccgtgtccccaggacagacagccagcgtcacctgctctggggataaattgcgcgatagatatgtttcctggtatcaacagaagccaggccacgtcccctgtcgtggtcatctatcaagacaccaagccggccctcgagggactccccgtgacgccgtattctctggcctccaatcgtgggaacacgacgccactctgaccatcagcggacgcgaggctgtggatgagtntgtacttttacgtgtcgagggtccgaggggacagcgactcgcgtccgtggtcgggcgggggtacaacggcgttacgaccgttcccgcggtacaacggcccgaacggcctccggccccctcggtacctcccg

SEQ ID NO: 388762 - DNA, 541 bp, Homo sapiens
  misc_feature: GZ8MTXP02JIV71.51.28.C06.1.454.CMB.2.raw
  modified_base (444)..(444): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtcccctgtcgtggtcatctatcaagacaccaagccggccctcgagggatccctgacgcgattctctggcctccactcgtagggaaacacacgccactctcgaccatccgagccgggacgcgacggctggtggatggacggcgtgtactttacgtgtcgaggcgtggacngcgacacgtcgccggtcggtcggggcgggggtaccaggccgtacgaccggtcccgtacggtccacggacccgacggccgtccgcccccgtggtcccg

SEQ ID NO: 388763 - DNA, 651 bp, Homo sapiens
  misc_feature: GZ8MTXP02IM7QQ.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcagccaccctccgtgtccgtgtccccaggacagacagccagcgtcacctgctctggggataaattgcgcgatagatatgtttcctggtatcaacagaacgccaggccatccccctgtcgtggtcatctatacaagacagcaagccgccctgacggactccgtgacgcgtattcctctcggcctccgtaaactccgtaggggaaaccaccgagcccactactagacccagtacgacgacggacgcgaggtccgtgtaggagtaggaggtcgttacgttacgttttaccgtagttaccgacgggtcggttacgggaccgaggaccggaaacgtacgtccgggtccggttacgggttaccgggggtaccggggggtaaaacccgacgggtaccgtaaccggtcccccggtttaccggaaccggttcccgaaaaccggtcccccggaaaacggtcccgttaccccggtccccccggtttaaccccggg

SEQ ID NO: 388764 - DNA, 691 bp, Homo sapiens
  misc_feature: GZ8MTXP02F5DCD.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcacgcccaccctccgtcgtcccgtcgtccccgaggacagacagccagcgtcactgctcgtagggtaataatgcgcgatagtatagttcgtttccgtggtactacaaacgagaacgccgacgcctacgtcccctgtcgtgtcatcatacaagacaccgaacgccgcctacgacggactcccgtgaccgcgtattctcgtcggccttaccacgttcgacggaaaccaccgacgaccctacgtcctacgacctaacgtccgacgggaccggggaaccgacgacgggtcgttagggtaggtacgtaggtacgggttccgtttacggtttaaccgttttacgtacggttacgggtacgggtccgggttaacgggacgtacgggaaccgtacgtacgggtccgggtaccgggttcgggggttacccgggggaccgggggtaaccacgggtcccgtaccggtacccggttcccggtacggccgaaccggacccggtacggcccgttacccggtcccccgttacggtccccg

SEQ ID NO: 388765 - DNA, 561 bp, Homo sapiens
  misc_feature: GZ8MTXP02GMVI5.51.28.C06.1.454.CMB.2.raw
  modified_base (259)..(259): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataattgcgcgatagatatgttcctggtatcaanagaagccaggccacgtcccctgtcgtggtcatctatcaagacacaagccggccctcgaggactcccgtgacgcgattctctcggcctccactcgtgggaaacacgacgccactctgaccatcgaggcgggacgcaggctggtggatggaggcttggtacttttactggtcgaggcgtgggacacggcgactacgtcgccggttcgggttaccgggggcgggggaaccgaacgggtcgtacggacccgttccgtacggtaaccgacgacccggacggtccgtaccggcccccgtcggtacccg

SEQ ID NO: 388766 - DNA, 573 bp, Homo sapiens
  misc_feature: GZ8MTXP02FWFZF.51.28.C06.1.454.CMB.2.raw
  modified_base (262)..(262): a, c, t, g, unknown or other
  modified_base (470)..(470): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatattgttcctggtatacaanagaagccaggccacgtcccctgtcgtgtcatctatacaagacaccaagccggccctcgacgggtactcccgtgacgcgtacttctcgtcgcctaccactcgtacgggaaacacgacgccactccgtacgaccagtcgacggaccgggacgacggaggcgtggtgagtggaggtctgttactttacgtgtcggaggccggtagggacgnggacgacgtacgtcggccggttacggtcgggggaccgggggacacggcgtacgccgtccgtcggaaccgacggacccgacggccgtccgtccccgtcggtccc

SEQ ID NO: 388767 - DNA, 568 bp, Homo sapiens
  misc_feature: GZ8MTXP02IQABI.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctccgtgtccgtgtccccaggacagacagccagcgtcacctgctctggggataaattgcgcgatagatatgtttcctggtatcaaacagaagccaggcccagtcccctgtcgtggtcatctatcaagacaccaagcggccctcgagggactcccgtgacgcgtattctctggccttacccacttcgtacggggaaaccaccacgccactctacgaccatcaggcggacgcgaggctggtagagtggaggtctagtacttttacgtgtcgaggcggtaggacaggacgacgtacgtcggccggttgggttaccgggggcgggggaacctaacggcgtacggtacccgtccgtcggtaacgacggcccgtaacggcctccggccccgtcggtccc

SEQ ID NO: 388768 - DNA, 552 bp, Homo sapiens
  misc_feature: GZ8MTXP02I8VXK.51.28.C06.1.454.CMB.2.raw
  modified_base (408)..(408): a, c, t, g, unknown or other
  modified_base (431)..(431): a, c, t, g, unknown or other
  modified_base (442)..(442): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaaacagaagccaggcccagtcccctgtcgtggtcatctatcaagacaccaagccggccctcgaggggactccccgtgacgcgattctctggccttccactcgtagggaacacgagccactctcgaccactcgacggcgggacgcgaggtcnggtgatgaggctgtacttttacngtcgaggtcgngggacaggcgaacgcgtggccgtcggtcggggcgggggtaccaaacggcgtaccgaccggtcccgtcggtaaccgcgacccgaacggccgtccgtcccccgtcggtaccc

SEQ ID NO: 388769 - DNA, 574 bp, Homo sapiens
  misc_feature: GZ8MTXP02IQE2V.51.28.C06.1.454.CMB.2.raw
  modified_base (472)..(472): a, c, t, g, unknown or other
  modified_base (494)..(494): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagcccaccctccgtgtccgtgtccccaggacagacagccagcgtcacctgctcgtggggataaattgcgcgatagatatgtttcctggtatcaacagaagccaggccacgtcccctgtcgtggtcatctatacaaagacaaccaagccggccctacgacggggactccccgtgaccgcgtatttcctcgttcggacctcccacgtccgtacggggaaaccaccgaactcccaaccttctacgaacctacgtacacggcgggaccgcgacggcgtggtaggatggaggtcgtagttacttttacgngtcgaggcgtgggacagcgacncgtcgccggttcggtcggggtcgggggacacggcgtacggaccgtccgcgtcgacgccgacgcgccgtccccgtggtccc

SEQ ID NO: 388770 - DNA, 511 bp, Homo sapiens
  misc_feature: GZ8MTXP02JGYQ8.51.28.C06.1.454.CMB.2.raw
  modified_base (256)..(256): a, c, t, g, unknown or other
  modified_base (333)..(333): a, c, t, g, unknown or other
  modified_base (366)..(366): a, c, t, g, unknown or other
  modified_base (384)..(384): a, c, t, g, unknown or other
  modified_base (386)..(386): a, c, t, g, unknown or other
  modified_base (390)..(390): a, c, t, g, unknown or other
  modified_base (394)..(394): a, c, t, g, unknown or other
  modified_base (396)..(396): a, c, t, g, unknown or other
  modified_base (398)..(398): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctgggataaattgcgcgatagatatgtttcctggtatnaacagaagccaggccagtcccctgtcgtggtcatcatcagacaccaagcggccctcagggatccctgacgcgattcnctggctccactcgtagggaacacacgtcaactncgacatcagcggacgcgngngtgngagngngngtgtacttacgtgtcgagcggtggacgacgcgacgacgtcgtcggtcggtcgggacggggacggacgacgcgtaccgtccgtcgtcgacgaccgacgccgccgcccgtcgtcg

SEQ ID NO: 388771 - DNA, 629 bp, Homo sapiens
  misc_feature: GZ8MTXP02HZUN0.51.28.C06.1.454.CMB.2.raw
  modified_base (266)..(266): a, c, t, g, unknown or other
  modified_base (283)..(283): a, c, t, g, unknown or other
  modified_base (299)..(299): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctcgtgtccgtcgtccccaggacagacagccagcgtcactgctcgtgggataatgcgcgatagatagtgtttcctaggtatacaacagacnccgaggccacgtccccngtcgtggtctatctancaagacagcaagccgcctgacggctcctgagcgtattcgtctcggtcctccgaactcgtacgggaccacacgaccctactctcgaccatacgacggcggaacgtcgaggtcgtggtagagtggtaacggtcttaggtttacgttttacgcggttacgtaggggtccggtagggaccgaggaccggaacgtaccggtcggtcccgggttacggggtttacccgggggaccgggggaccgtaaacggtccgtaccgggtccccggtaccggtccggtaaccgaccggtaccccggtaacggtccccgttaccccggtacccccgtttcccgg

SEQ ID NO: 388772 - DNA, 611 bp, Homo sapiens
  misc_feature: GZ8MTXP02H8XFD.51.28.C06.1.454.CMB.2.raw
  modified_base (425)..(425): a, c, t, g, unknown or other
  modified_base (463)..(463): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagcccaccctccgtgtccgtcgtccccaggacagacagccagcgtcacctgctcgtaggggataattgcgcgatagattattgtttccgtggtatacaacagaacgccgacggccacgtccccgtgtcgtggtacatctatacaagaccaacgaacgccggccctacgacgggtactcccgtggacgcgtattcgtcgtcggcctccgactcgtacggaaaccacgacgcccactcacgaccagacgacggcgggacncgacggtcgtggaggatggagtcgtagttactttacgngtacgagggtcggtacgggaacacggacggaacctcggtccggtcggggttcggggtccgggggaccgggggaacaacggtcgtaccggacccgtccgtccggtaacgaccgacccggacgtcccgtcccggtcccccgtggtacccc

SEQ ID NO: 388773 - DNA, 611 bp, Homo sapiens
  misc_feature: GZ8MTXP02H63OZ.51.28.C06.1.454.CMB.2.raw
  modified_base (465)..(465): a, c, t, g, unknown or other
  modified_base (522)..(522): a, c, t, g, unknown or other
  modified_base (592)..(592): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgcccacctccgtgtccgtcgtccccgagacagacagccagcgtcactgctcgtgggataatgcgcgatagattagtgtttcctggtactacaacagaacgccacggcctacgtccccgtggtcgtggtctatactactacaacgaaccaaccgaacggcccggtaccctacgacggggtacctccccgtagaccgcgtactttcctcgtacggtccctacccgacgttcgtacgggaaaccaccgacgcccaacttccacgaacccagtccgacggccgggacgtcgaggcgtggnggagtggacgtcttacggttactttttagcggtcggaggtcggtaggacgcgcgacncgtggccggttggaccgggggcggtaaccaggtccgtcgaccgtcgtaccggcgaccgaccgacgtcccncccggccccgttcgacccg

SEQ ID NO: 388774 - DNA, 573 bp, Homo sapiens
  misc_feature: GZ8MTXP02HVTUJ.51.28.C06.1.454.CMB.2.raw
  modified_base (260)..(260): a, c, t, g, unknown or other
  modified_base (290)..(290): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaanagaagccaggccagtcccctgtcgtggtcntctatcaagacaccaagcggccctcgagggactccctgacgcgtattctctggcctccactcgtggggaacacagcccactctcgaccatcagcgggacgcgacggcgtggtacgggagtaggaggtctaggtactttttacgtcggttaccgagggtcggtggggacaggcgaccgacgtcggccggtcggttccgggggccgggggaacccgaaaggccgtcggacccgtcccgtcgggtccgacggcccgaaacgggctcccggcccccgtcggtccccg

SEQ ID NO: 388775 - DNA, 639 bp, Homo sapiens
  misc_feature: GZ8MTXP02JRMK0.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacaggcagccagcgtcacctgctctggggataaattgcgcgatagattatgtttcctggtatcaaacagaagccaggccacgtcccctgtcgtgtcatctatacaagacaccaagccggccctcgagggactcctgacgcgtattctacgtggtcctacctacgtcgtacggggaaaccacgaccgaccctactcctacgacccatccgacgggccgggaaccgcgaccgggcgtgggtacggagtacggacggtcgttacggttacttttaacgtggtaccgagggtcggtagggacgaggcgacgtacgtcgggtaccggttcggggttaccggggaccgggggaccgtaaacggtccgtaccggtacccggttcccggtccggtaaccgaacccggccccggtaacgggcccgtccccggtaccccccgtcggtacccccg

SEQ ID NO: 388776 - DNA, 560 bp, Homo sapiens
  misc_feature: GZ8MTXP02JUH27.51.28.C06.1.454.CMB.2.raw
  modified_base (294)..(294): a, c, t, g, unknown or other
  modified_base (335)..(335): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcagccaccctccgtgtccgtgtccccaggacagacagccagcgtcacctgctcgtgggataaattgcgcgatagatatgtttcctggtatcaacagaagccaggccagtcccctgtcgtgcatctancaagacagcaagcgcctcgaggactccctgagcgatttccncgttggctcccaaacgtcgtaggggaaccacgacgaccacttcacgaccatcgacggcgggacgccgaggcgtgtggatgggagcttaggttacttttagcggttcgaggtccggttagggacaggaccgaagcgtgtcccggtggttccggggacgggggtaccacggtccgacggtaccgtccgtaacggtcaacggcccgaaggccctccggccccttccgg

SEQ ID NO: 388777 - DNA, 584 bp, Homo sapiens
  misc_feature: GZ8MTXP02I9OHD.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctctggggataaattgcgcgatagatatgtttcctggtatcaacagaagccaggccagtcccctgtcgtggtcatctatcaagacaccaagccggcctcgagggactcccgtgacgcgtattctcgtggcctacccactcgtacgggaaaccacgacgcccactctacgaccatcgacggccgggacgacgaggcgtgtggatggaggtctggttacttttacgtgtacgacgggtcggtgggacacggcgacgacgtcggccggttcgggttcgggggaccgggggtaccaaggccgttacggtacccgttccggtcggtaaccgacggacccgaacgggccgtcccggtcccccgtcggttcccg

SEQ ID NO: 388778 - DNA, 569 bp, Homo sapiens
  misc_feature: GZ8MTXP02FW3T1.51.28.C06.1.454.CMB.2.raw
  modified_base (403)..(403): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtcccctgtcgtggtcatctatcaagacaccaagccggccctacgagggactccctgacgcgacttctcgtggcctaccactcgtacgggaaacacagacccactctacgaccatcgacggcgggaacncgaggctggtgatgagctagtacttttgcgtgaggcggtgggacaggcgacaccgtggcccggttagggttccggggacgggggtaccaaggtcgtaccggaccggtcccgttccggaaccgacggaccccgaaacgggtccctcccggcccccgtcgggtacccc

SEQ ID NO: 388779 - DNA, 663 bp, Homo sapiens
  misc_feature: GZ8MTXP02HQ3SU.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctccgtgtccgtgtccccaggacagacagccagcgtcacctgctcgtggggataaagttgcgcgatagatatgttcctggtatacaacagaacgccgaggccacgtcccctgtcgtggtctatctatacaagacacaacgccgcctgacgggctcccgtgaccgcgtacttctcgtcggcctaccactcgtacgggaaccacgacgccctactccgtacacctagtccgaacgggcccggacgccgacgggtcgtagggtacgggtagtgggacgggtccttaggtttaccgtttttaccgtggtaccggtacggggtacgggttacgggaacgacggtaccggaaccgtacggtcgggtcccgggttcggggttacccgggggaccgggggaaacctacgggccgttaccggacccggttaccggtccgggtaaccgacccggacccggtaccggcccgttccccggtcccccgttacgggtccccg

SEQ ID NO: 388780 - DNA, 643 bp, Homo sapiens
  misc_feature: GZ8MTXP02JCZ7M.51.28.C06.1.454.CMB.2.raw
  modified_base (346)..(346): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctccgtcgtccgtcgtccccaggacagacagccagcgtcacctgctcgtgggataaatgcgcgatagatattgtttcctggtatcaaacagaacgccacggccacgtcccctgtcgtgtctatctatacaacgacaccgagccgccctcgaggctccgtgacgcgtattcncgtggcctccacgtcgtacgggaaccacacgccctactctacgaccatcgacgggcggacgcgagggctaggtcgagtaggtaccggtcgttacgttaaacgtttttcgtcggtacggtggggtacgtcggggacaacggccgaccgtacgtccgggccgggtttcgggtacccgggggacgggggaaccctaaacgggtccgtaccgggtaaccccgtccggttaccgggtaacccgtacccggtacccccggaacgggtcccccgtcccggtaccccccgggttacgtacccccg

SEQ ID NO: 388781 - DNA, 625 bp, Homo sapiens
  misc_feature: GZ8MTXP02I4IAR.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccatgtccgtgtccccaggacagacagccagcgtcacctgctctggggataaattgcgcgatagatatgtttcctggtatcaacagaagccaggccagtccccctgtcgtggtcatctatcaagacaccaagcggccctcgaggatccctgacgcgtattctctcggctccaaactcgtgggaaccacaacgccactctgacccatcgagcgggacgcgaggcgtagtggataggacggtacgttcgtacctttttaacgtggttaccgaacggggtccggttaggggaccgaaggccggaccaacgttcggtcccgggtttcgggtttccgggggaccggggggtaaccaaacgggtcccgttacggtaaccccggttacccgttccgggttacccgaaccggtacccccgaaagggtcccgttacccggaccccccggtttcccggg

SEQ ID NO: 388782 - DNA, 532 bp, Homo sapiens
  misc_feature: GZ8MTXP02JH547.51.28.C06.1.454.CMB.2.raw
  modified_base (336)..(336): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggcctcaggactccctgacgcgattcnctggcttaccactctacgggaacacacgccactctcgaccatcacgcggacgcacgctgtgatggagctgtactttacgtgtcgaggcggtaggacagcgactacgtgccggtacggttcgggccgggggaccaaggtcgcggtaccgtccgttcggccgacgccccaagggtcctccgtcccccgtcggtccccg

SEQ ID NO: 388783 - DNA, 634 bp, Homo sapiens
  misc_feature: GZ8MTXP02JDYBU.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttctggtatcaacagaacgccaggccacgtcccctgtcgtggtcatctatcaagacacaagccgccctcgaggctccgtgacgcgtattctctggccttccactctacgggaacacgagccgacgtctacgacccatcgacggcgggtacgcaggctaggtggagtggagggtctacggttacctttttacgaggttcggaacgggtcggtacggggaacgacggaccgaaccgtacgtccggacccgggttacggggttccgggggacccggggggaaaaccctaacgggtcccggttaccggaaccccgggttccccgtaccggggtcccgaacccggacccggtaaccggcccgtacccccggtcccccggttccccccggttacg

SEQ ID NO: 388784 - DNA, 642 bp, Homo sapiens
  misc_feature: GZ8MTXP02GZR6A.51.28.C06.1.454.CMB.2.raw
  modified_base (397)..(397): a, c, t, g, unknown or other
  modified_base (478)..(478): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtcgtccccaggacagacagccagcgtcacctgctcgtgggataaatgcgcgatagattatgttcctggtatcaacagacgccgaggccacgtcccctggtcgtgtcatctatcaagacacacgccggacctcgaagggactcccgtagacgtcgtattctcgtcggaccttccactccgtagggaaaccacgacgtccactcctacacctancgacggccggaacgcgacggtcgtggtagagtgacggtcttagttactttttacgcggttacggacggtcggtacgggacncgggacgttaaccgacgggttcggcccggggttcggggttacccggggggaccgggggaaccgtaacgggtcccgtaccggggtacccccggttcccggttaaccggccggacccggaacccggaccggtcccgaccccggtcccccgttacgggttacccccg

SEQ ID NO: 388785 - DNA, 608 bp, Homo sapiens
  misc_feature: GZ8MTXP02I56I7.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttctggtatcaacagagccaggccagtcccctgtcgtgtcatctatcaagacaccaagccggccctcgacgggactccctgacgcgtattctctcggcctccactcgtagggaacacacgaccactctacgaccagtacgacggcgggacgacgacggcgtggtgggatggagggtcttagtacgttttactcggtcgtagggcggtgggaacgcggacgaccgtacgtcggtcccggttcgggttccgggggaccgggggaccaaacgggtccgtacggtaccccggttcccgttaccgggtaaccgacccggacccgtaaccgggtcccgtacccggtcccccgttacgggttaccccg

SEQ ID NO: 388786 - DNA, 636 bp, Homo sapiens
  misc_feature: GZ8MTXP02HJSW2.51.28.C06.1.454.CMB.2.raw
  modified_base (460)..(460): a, c, t, g, unknown or other
tcagcgatcgtatacacgaccggtgctcgatttagagctcacgtattggggtttggggctgggcctcaggaagcagcatcggaggtgcctcagccatggcatggatccctctcttcctcggcgtccttgcttactgcacaggtatttgtggcctcctatgagctgactcagcccaccctccgtgtccgtcgtccccaggacagacagccagcgtcacctgctcgtgggataattgcgcgatagattatcgtttcctggtatacaaacgagaacgccacggccacgtcccctgtcgtgtcatacgtatacgaagtacgagacaacggccggccctagacgggacctcccgtagacgtcgtacttctcgttcggacctaccgtacctcggtacgggaaccacacgacccactccctagaaccctagaccgacgggcccggggacgcggacgggtcttagggnggtacgtaggacggtcgttacgtttaactttacggcgttacggacgggtcggacgggtacgacgccgaaccgtcggtcggtaccgggtcgggttccggggacccgggggatacggcgtaccgaacccggttcgccggtcgaccgtacccggacgttccccgccgtacccccgtccg

SEQ ID NO: 388787 - DNA, 646 bp, Homo sapiens
  misc_feature: GZ8MTXP02ISJJQ.51.28.C06.1.454.CMB.2.raw
  modified_base (236)..(236): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctccgtgtccgtcgtccccaggacagacacgccagcgtcactgctcgtgggaataattgcncgatagatattcgttctggtatcaacagacgccacgccacgtcccctggtcgtgtctatctatacaacgacaaccgtagcccggcctcgaggtcctccgagacgcgtattctcgtcgccttaccacgttcgacgggaaaccacgtccgacctacgttctacgacctagacgacggcgggacgacggagcgtggtggagtggagtcttacggttacttttcgcggtacgacggggttcggacgggacgaggtaccgtaccaccgggttcggtcccggggttaacgggttccggggggaaccggggtaacaaccgggtccggtttaccccggacccggttaccgttcccgggtaaccgacccgggtacccctacgggtcccgtcccccggtcccccgttaaccggttccccg

SEQ ID NO: 388788 - DNA, 523 bp, Homo sapiens
  misc_feature: GZ8MTXP02IO5RE.51.28.C06.1.454.CMB.2.raw
  modified_base (257)..(257): a, c, t, g, unknown or other
  modified_base (261)..(261): a, c, t, g, unknown or other
  modified_base (275)..(275): a, c, t, g, unknown or other
  modified_base (381)..(381): a, c, t, g, unknown or other
  modified_base (398)..(398): a, c, t, g, unknown or other
  modified_base (406)..(406): a, c, t, g, unknown or other
  modified_base (433)..(433): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggattgtggcctcctatgagctgactcagccaccctccgtgtccgtgtccccaggacagacagccagcgtcacctgctctgggataaattgcgcgatagatatgttcctggtatcaanagancaggccagtccccngtcgtgcatctatacaagacacaacgccggcctcgaggctacccgtgacgtctattctcgtcgcctaccacttccgaggaaaccacacgaccactctacgacctancgaagccggacgcaggngtgtgagngagtgtagtacttcgtcgtcgacgcgnggacgacgacgacgcgcgcggtcggtcgggacgggacgacgacgtcgaccgtccgtcgcgaccgaccgacgccgtccgtcccgtccgtcg

SEQ ID NO: 388789 - DNA, 617 bp, Homo sapiens
  misc_feature: GZ8MTXP02GFNUZ.51.28.C06.1.454.CMB.2.raw
  modified_base (236)..(236): a, c, t, g, unknown or other
  modified_base (302)..(302): a, c, t, g, unknown or other
  modified_base (482)..(482): a, c, t, g, unknown or other
  modified_base (518)..(518): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcagcccaccctccgtgtccgtcgtccccaggacagacagccagcgtcacctgctcgtgggataatgcgngatagatatgtttctggtatcaacagaacgccaggccacgtcccctgtcgtgtcatctatacaaanaccaaccacgccgcctcgacggactcccgtagaccgcgtacttccgtacgtcggtacctacccgtacgttccgaggggaaaccaccgacaccctacgttcacgaccaagtcccgaagggccggggaaccgcgacgggtctagggttaggatcgggaaggtccttagtttacgttttacgnggttacggacggtcgggacggacacggacggtaccncggttcggccgggtttacggtccgggggacggggaccaggtcgtcgtacccggtctccggaacgcgaacccgcggtccgaccgtcccccgtacggtccc

SEQ ID NO: 388790 - DNA, 650 bp, Homo sapiens
  misc_feature: GZ8MTXP02I33O8.51.28.C06.1.454.CMB.2.raw
  modified_base (471)..(471): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctccgtgtccgtgtccccaggacagacagccagcgtcacctgctcgtgggaataagttgcgcgatagattattgtttcctggtatacaaacagaacgccaggccacgtcccctgtcgtgtcatcatcaagacaaccgaacgccgccctgaacgggtactcccgtagaccgcgtacttctacgtcggccttacccaccgtcgtagggaaaccacgtaccgccctaacgtctacgaccagtaccgaggcgggacacgacggctaggtagacgtggacgtcgtagttaccgttttacgnggtcgaagggcggtagggaccgacggtacgacctacgtcggtccggtacggggttccgggggaccgggggaaccgtaacggtccggtaccgggtaaccccggttcccggttcggtaacccgaacgggtaccccgtaacgggtccccgtccccggtacccccggtttccggttaaccccg

SEQ ID NO: 388791 - DNA, 661 bp, Homo sapiens
  misc_feature: GZ8MTXP02HCM9R.51.28.C06.1.454.CMB.2.raw
  modified_base (265)..(265): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggcctcctatgagctgactcacgccaccctccgtgtccgtcgtccccaggacagacacgccagcgtcacctgctcgtaggggataaatgcgcgatagattatgtttcctgtatcaanagaacgccacggccacgtcccctgtcgtgtcatctatacaagaccaaccgaagccgccctacgagggtacctcccgtgacgcgtactttccgtcgtcggtccctaccgtaccgttccgggaacgaaccaccgacctacccgtacctaccgtaccaccacgtaccggacggggaccggaccggtacgtcggtcggtaggtacggacgtaggtacggttacgttacgtttacgttttacggcgtacgggacgggtacggtacgacgtaccggacgtacgtcggtcggtccggggttacggggccgggggaacgggaacgtacggtccggtaccgtccccggttcggaccggaacgacccggtaccgaccggtcccgtccccgtacccggtccgtcccg

SEQ ID NO: 388792 - DNA, 721 bp, Homo sapiens
  misc_feature: GZ8MTXP02HT3KL.51.28.C06.1.454.CMB.2.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgcccaccctccgtgtccgtcgtccccaggacagacacgccagcgtcacctgctcgtaggggaataaagttgcgcgatagattatgtttcctggtatcaaacagaacgccacggccacgtcccctgtcgtggtcatctatacaaacgaccaacgaacggccggtaccctacgaacggggtacctccccgtaggaccgtacgtacttcgtcgtcggtcctacctacgtcgtacgggaaccaccgacgccctactcctacgacctagcgacgggccgggacgtacgaggtccgtggtacggacgtggtaacggtcgtttacggtttaacgtttttccggaggttaccgggaacggggtccgggttaggggacctaacgggaccggtaaacgtaccggtcgggtcccgggttcgggggttacccgggggaccggggggtaaacccaacggggtcccggtaaccggtaccccggttaccggttcccgggtaaccggaaccccggtacccggaaccgggtccccgttcccccgggtacccccgtttaccggtaccccg

SEQ ID NO: 388793 - DNA, 644 bp, Homo sapiens
  misc_feature: GZ8MTXP02INVCP.51.28.C06.1.454.CMB.2.raw
  modified_base (258)..(258): a, c, t, g, unknown or other
  modified_base (267)..(267): a, c, t, g, unknown or other
  modified_base (291)..(291): a, c, t, g, unknown or other
  modified_base (303)..(303): a, c, t, g, unknown or other
  modified_base (400)..(400): a, c, t, g, unknown or other
  modified_base (408)..(408): a, c, t, g, unknown or other
  modified_base (439)..(439): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgcccacccgtccgtgtccgtcgtccccaggacagacagccagcgtcacctgctcgtgggataaagttgcgcgatagatatgttctgtancaacagacncacgccacgtcccctgtcgtgtcntactactacaanaccaccgaacgccggccctaggaacgggtactacccgtggaaccgtcgtacttctcgtcgtacctacctacgtcgtaggaaccacgacgccactacncgtacacncgacgggaccgtacgcggacgcgtggacgtnggtacgtcgttacggttacttttacgcgtcgggacggtcggtacgggacgacggtcgtaaccggtcgtaccgggtacggggttcggggtacccgggggaccgggggtaaccaacgggtccggtcccgacccggtcccggttaccggtaaccgaaccggaccccggttacggccccgtaccccggtcccccgggttcgtacccccg

SEQ ID NO: 388794 - DNA, 557 bp, Homo sapiens
  misc_feature: GZ8MTXP02H5E3O.51.28.C06.1.454.CMB.2.raw
  modified_base (314)..(314): a, c, t, g, unknown or other
  modified_base (319)..(319): a, c, t, g, unknown or other
  modified_base (336)..(336): a, c, t, g, unknown or other
  modified_base (392)..(392): a, c, t, g, unknown or other
  modified_base (398)..(398): a, c, t, g, unknown or other
  modified_base (406)..(406): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctctatgagctgactcagccacctcgtgtccgtgtcccaggacagacagccagcgtcacctgctcgtggggataaattgcgcgatagatatgttcctggtatcaacagaacgccaggccacgtcccctgtcgtggtcatcatacaagacaaccaagcggtcccnaggcncccgtgacgcgattccntcggcacacttcgaggaaaccacaacgcccaactcacgaccatcaacggcgggacngtacgngtgagagngagtgtgtacgttagtgtcgacgtaggtacggacgacgacgacgtacgtcgtcggtcgggtcggggaccgggggacggacggtaccgtacgtaccggtaccgtaccggtaaccgaccgaccgaccggaccgtcccgtcccgtaccgtaccg

SEQ ID NO: 388795 - DNA, 600 bp, Homo sapiens
  misc_feature: GZ8MTXP02JPEZ2.51.28.C06.1.454.CMB.2.raw
  modified_base (259)..(259): a, c, t, g, unknown or other
  modified_base (461)..(461): a, c, t, g, unknown or other
  modified_base (469)..(469): a, c, t, g, unknown or other
  modified_base (478)..(478): a, c, t, g, unknown or other
  modified_base (496)..(496): a, c, t, g, unknown or other
  modified_base (545)..(545): a, c, t, g, unknown or other
  modified_base (573)..(573): a, c, t, g, unknown or other
tcagcgatcgtatacacgaccggtgctcgatttagagctcacgtattgggtttggggctgggcctcaggaagcagcatcggaggtgcctcagccatggcatggatccctctcttccctcggcgtccttgcttactgcacaggatttgtggcctcctatgagctgactcagcccaccctccgtgtccgtcgtccccaggacagacagccagccgtcacctgctcgtagggataatgcgcgatagattattgttcctgtanacaaacgagaagccgacgcctacgtcccctgtcgtcgtctactcgtatacgaaacgaccaaccgtaaggcccggtcccttacggaacgggtacctcccgtagacccgtacgtacttccgtcgcggtccctaccgtacgtcgtaaacgggaccacgagcccctagtcctacgaccagtccgaacggcggactgagcgtagtgngtgacgtntatacgttngtacgtagcggtaggacngccgaacgtgtaccgggtcggcggttaccgggggcggtaaccacggtcncccggtccgtcgtcgaacaccggaccgnggtcccacccggtaccccttgcccccg

SEQ ID NO: 388796 - DNA, 654 bp, Homo sapiens
  misc_feature: GZ8MTXP02IXTNC.51.28.C06.1.454.CMB.2.raw
  modified_base (347)..(347): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctccgtgtccgtgtccccaggacagacagccagcgtcacctgctctgggataatgcgcgatagatatgtttcctggtatcaacagaacgccaggccagtcccctgtcgtggcatctatcaagacaccaagccggccctcgacgggtactccccgtagacgccgtagtttccncgttcggcccttacccgaccttccggtacggggaaaccacgaccgaccctaacgttctacgaacccacgtccgaacgggccgggaccgacgacgggacgtggtaggagtggaagggtcgttagttaccttttacgtcggttcggacggtccggtgggaacgtggaccgacgtacgtcggtcccggttacggggttccgggggaccgggggtaccgaaacggccggtaccggtaccccgttcccggtaccggtccgtacccggacccggaacggtcccgtcccggtacccccggttcggtttaccccg

SEQ ID NO: 388797 - DNA, 683 bp, Homo sapiens
  misc_feature: GZ8MTXP02JAD6R.51.28.C06.1.454.CMB.2.raw
  modified_base (331)..(331): a, c, t, g, unknown or other
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctcgtcgtccgtgtccccaggacagacagccagcgtcacctgctcgtgggaataaagttgcgcgatagatatgtttcctggtatcaacagaagccaggccagtcccctgtcgtgcatctatcaacgaccaaccgagccgcctcgaggctcctgacncgtattctcgtggaccctacctacgtcgtaacggggaaaccaccgaccggaccctaccttcgtaacccgacctaacgaccgaacggggacggggtaacccgcggacgggtcttcggggtacgggtaaacgtgggtaaacggggtcctttacggtttaacccgttttttacgcggttacggtaacggggtcggttacgggacgacggaccgacgtacggtcgggtcccggttcggggttccgggggaacgggggaaccctaaacgggccggtccggtaaccccggttccggttacggtcccgtaaaccggccccggtaacggtccccgtacccggtccccgtcggtttacccc

SEQ ID NO: 388798 - DNA, 526 bp, Homo sapiens
  misc_feature: GZ8MTXP01EWBNO.44.23.C01.1.454.CMB.2.raw
  modified_base (273)..(273): a, c, t, g, unknown or other
  modified_base (395)..(395): a, c, t, g, unknown or other
  modified_base (523)..(523): a, c, t, g, unknown or other
tcagacagtatatacacgaccggtgctcgatttagtacacgtgattagggattggggagtcagaccctgtcaggggacagcatggacatgagggtcccgctcagctcctgggctcctgctgctctggctcccaggttcgagatgtgacatcgagatgacccagtctccttccttcctgtcttcttctgttggaggcagcgtcaccatcactttgccgggcgagtcaggtcgttttcggtgctgttgcctggtttacaacgaaaaagggggganaggccccctaaaggtccctcgtctctcgtgaaaccagactggaagtagagtcccgcaggttcagtgccagtccaggtgtggccccgagtcatctcaaccattgcgacctgcggcctgaagtnttctgcaacttattctgtcagcagtatcatagtcgcccggttctacgttttggccgaggggaccaagctaggaaatcaaacgaactgtgcttgcaccatcttgttcttcaatcttcccgccattctgntaa

SEQ ID NO: 388799 - DNA, 533 bp, Homo sapiens
  misc_feature: GZ8MTXP01B63M2.44.23.C01.1.454.CMB.2.raw
  modified_base (269)..(269): a, c, t, g, unknown or other
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaacgaaaagggggnaggcccctaaggtcctcgtctctcgtgaaaccagactggaaggtagagtcccgtcaggttcagtgccagtccaggtggtggccccgagtcactctcaaccattgcgacctgcgcctgaagattctgctaacttatttctgtcagcagtatcatagtcgccccggttctacgttttggcctagggggacccaaaggctaggaaatcaaacgaactgtggcttggcaccgatcttgttcttcaatcttcccgccattctgaattaa

SEQ ID NO: 388800 - DNA, 543 bp, Homo sapiens
  misc_feature: GZ8MTXP01ELA78.44.23.C01.1.454.CMB.2.raw
  modified_base (241)..(241): a, c, t, g, unknown or other
  modified_base (273)..(273): a, c, t, g, unknown or other
  modified_base (307)..(307): a, c, t, g, unknown or other
  modified_base (539)..(539): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctgggtttcaacgaaaaagggggngaggcccctaaggtcctcgtctctcgtgaaaccngactggaaggtagagtcccgtcaggttcagtgccagtccaggtggtggcccgagtccatctcaaccattgcgacctgcggcctagaagtattctgctaacttattctgttcagcagtatcatagtcgtccccggtttctacgttttcggcctagggggacccaaggtcctagggaaactcaaaacgactagtggcttgcaccatcttgttcttcaatcttcccgcattctgnttaa

SEQ ID NO: 388801 - DNA, 524 bp, Homo sapiens
  misc_feature: GZ8MTXP01EQFE7.44.23.C01.1.454.CMB.2.raw
  modified_base (240)..(240): a, c, t, g, unknown or other
  modified_base (271)..(271): a, c, t, g, unknown or other
  modified_base (304)..(304): a, c, t, g, unknown or other
  modified_base (519)..(519): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcaggtcgttttcggngctgttgcctggtttacaacgaaaagggggnaggcccctaaggtcctcgtctctcgtgaaaccngactggaaggtagagtcccgtcaggttcagtgccagtccaggtggtggcccggagtccactctcaaccattgcgacctgcggcctggaaagtattctgcaacttattctgtcagcagtatcatagtcgcccggttctacgttttggccaggggaccaagctaggaaatcaaacgaactgtggcttgcacatcttgcttcaatctcccgcattctnaataa

SEQ ID NO: 388802 - DNA, 615 bp, Homo sapiens
  misc_feature: GZ8MTXP01EPV93.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggaggggaatgggagtggattggtgacatccattatacgtggggcgacgtactactctccgtccctcaagagtcgtctcaccatttcgaggacacgtccatcgaaccccgcttctccctgaaactcgaccctccgtcgacccgccgcggacacggtcgtttattctgtgcgagcgagactggtcttcaatctagtcggggccgtggggctacccgtggtccacgtgtcctcctcacgtccttaccgacccgaaacggggcccctaacgttcccgggttccctttccccccgtgggccccgttcccccgttcggccccttccccggacgggtaaccgcccgtacccgttccggtcggggggcccaacccggg

SEQ ID NO: 388803 - DNA, 559 bp, Homo sapiens
  misc_feature: GZ8MTXP01CQNQ8.44.23.C01.1.454.CMB.2.raw
  modified_base (361)..(361): a, c, t, g, unknown or other
  modified_base (495)..(495): a, c, t, g, unknown or other
  modified_base (513)..(513): a, c, t, g, unknown or other
tcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatggagtggattggtgacatccattatactggggcgacgtactactctccgtcctcaacgagtcgtctcaccaatttcgngggacacgtccatcgaaccgctctccctgaaactgacctccgtgaccgccgcgacacggccgttattctgtggcgtaggcgagactggtcttttcaaactctaatggggcccttgggcacccttgggttacccncgttcgtccttccgttcncgtccttcccgaaccgaacgggcccacgttccggttcccttccccg

SEQ ID NO: 388804 - DNA, 628 bp, Homo sapiens
  misc_feature: GZ8MTXP01D1DH9.44.23.C01.1.454.CMB.2.raw
  modified_base (240)..(240): a, c, t, g, unknown or other
  modified_base (272)..(272): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgtttcggngctgttgcctggtttcaaacgaaaaggggganaggcccctaaaggtccctcgtctctcgtacgaaacagacgtagggaaggtagacggtccccgtacgaggttcaggtcgccagtccgagggtcgggtcgggaccccggagtaccacgtcctaccaaaccctagttaacgccgtacccgtgggccggcctaggaagtactttcgtagtacctaactttatttccgtaggttaccaagtctaagttataccgattacggtccgtccccgggtttcttaacgttttcggaccgtagggggaacccaggacctaaggaaataccgaaaacgacgtgaagtcttgccactatcttcgttcttcaattcccttaaccgcattctgttaattaa

SEQ ID NO: 388805 - DNA, 408 bp, Homo sapiens
  misc_feature: GZ8MTXP01AVGCO.44.23.C01.1.454.CMB.2.raw
  modified_base (370)..(370): a, c, t, g, unknown or other
  modified_base (402)..(408): a, c, t, g, unknown or other
tcagacagtatatacacgaccggtgctcgatttagtacacgtgattagggattgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagcttccaccaagggcccatcggtctccccctggcgccctgctccaggagcacctctgggggcacagcggcctggctgcccctggtcaaggactactcctatntactgtctgagcgggctggcaaggcgcatagnnnnnnn

SEQ ID NO: 388806 - DNA, 543 bp, Homo sapiens
  misc_feature: GZ8MTXP01EB012.44.23.C01.1.454.CMB.2.raw
  modified_base (241)..(241): a, c, t, g, unknown or other
  modified_base (272)..(272): a, c, t, g, unknown or other
  modified_base (307)..(307): a, c, t, g, unknown or other
  modified_base (368)..(368): a, c, t, g, unknown or other
  modified_base (389)..(389): a, c, t, g, unknown or other
  modified_base (435)..(435): a, c, t, g, unknown or other
  modified_base (527)..(527): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttcaaacgaaaaggggganacggcccctaaggtcctcgtctctcgtagaaaccngactggaagtagacgtcccgtcaggttcagtgccagtccaggtggtggcccgagtcactcncaacatgcactgcgctgagtntctgctaacttattctgtacagtcagtatcatagtcgtcccggttntacgttttcggaccgtagggggacccaaggtctaagggaaactaccgaaaacgactggtggcttgccacatcttgttcttcaactcctcccnctattctgttaattaa

SEQ ID NO: 388807 - DNA, 588 bp, Homo sapiens
  misc_feature: GZ8MTXP01BKB4O.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggagggaatggagtggattggtgacgatccattatacgtggggcgacgtactactctccgtcctcaacgagtcgtctcaccaatttcgaagggacacgtccactcgaaccgcttcctccctgaaacctgacctccgtgacccgccgcgacacggtccgtttattctgtgggcgtaggcgagtactcggtctttcaattcgtagtcggggccgtggctcccgttgggtccttacgttcggtccttcccgttcacggtccctttcccgaaccgaacggggccccttagttcccgggttcccttttccccccgg

SEQ ID NO: 388808 - DNA, 575 bp, Homo sapiens
  misc_feature: GZ8MTXP01BWT5J.44.23.C01.1.454.CMB.2.raw
  modified_base (241)..(241): a, c, t, g, unknown or other
  modified_base (270)..(270): a, c, t, g, unknown or other
  modified_base (454)..(454): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttcaacgaaaagggggnaggccctaaggtcctcgtctctcgtgaaaccagactggaaggtagagtcccgtcaggttcagtgccagtccgagggtggcgggccccggagtccacgtctccaacccattcgcgacctggccggcctagaagtattctagctaactttattctgtacagctagtatcatagtccgccccggttntaccgttttcggaccgaacggggtacccaacgtcgtaacgggaaaataccgaaaacgtacgtggtgggacttggccaccgatcttgttccttctaactccttcccgctattctgaattaac

SEQ ID NO: 388809 - DNA, 418 bp, Homo sapiens
  misc_feature: GZ8MTXP01CT0R6.44.23.C01.1.454.CMB.2.raw
  modified_base (378)..(378): a, c, t, g, unknown or other
  modified_base (410)..(418): a, c, t, g, unknown or other
tcagacagtatatacacgaccggtgctcgatttagtacacgtgattagggattgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctgggggccaagggaccacgggtcaccgtctcctcagcttccaccaagggcccatcggtcttccccctggcgccctgctccaggagcacctctgggggcacgagcggccctgggctgcccctggtcaggactacttccctatntactgtctgagcgggctggcaaggcgcatagnnnnnnnnn

SEQ ID NO: 388810 - DNA, 585 bp, Homo sapiens
  misc_feature: GZ8MTXP01B1YCT.44.23.C01.1.454.CMB.2.raw
  modified_base (240)..(240): a, c, t, g, unknown or other
  modified_base (271)..(271): a, c, t, g, unknown or other
  modified_base (305)..(305): a, c, t, g, unknown or other
  modified_base (404)..(404): a, c, t, g, unknown or other
  modified_base (567)..(567): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggtcgttttcggngctgttgcctggtttacaacgaaaagggggnacggcccctaaggtcctcgtctctcgtgaaaccngactggaagtagagtcccgtcaggttcagtgccagtccgaggtggtcgggcccggagtccactctcaaccattaacgcgacctgccggcctagaaagtntctgctaacttattctgtacagcagtatcattagtcgtccccgggttctacgttttcggaccgtaacgggggaccaaacggtcgtaacgggaaacttaccgaaaacgtaactggtaacgggacttggacacccgtatcttgttccttcaacttccttaacccnctacttcctgttaattaa

SEQ ID NO: 388811 - DNA, 569 bp, Homo sapiens
  misc_feature: GZ8MTXP01CE8CK.44.23.C01.1.454.CMB.2.raw
  modified_base (272)..(272): a, c, t, g, unknown or other
  modified_base (307)..(307): a, c, t, g, unknown or other
  modified_base (388)..(388): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggtgctgttgcctggttacaacgaaaaggggganacggcccctaaggtcctcgtctctcgtagaaaccngactggaagtagacgtcccgtcaggttcagtgccagtccaggtggtggccccgagtcatctcaaccatgcactgcgctgantctgctacttattctgtcagcagtatctatagtcgtccccggttctacgttttcggaccgtaggggacccaaggtaccgtaagggaaactaacgaaaacgtaacgttggtaacggtcgttgccaaccgtactcgttcgttcctttctaacttcccttcccgctattcctaagttaattaag

SEQ ID NO: 388812 - DNA, 560 bp, Homo sapiens
  misc_feature: GZ8MTXP01EN579.44.23.C01.1.454.CMB.2.raw
  modified_base (368)..(368): a, c, t, g, unknown or other
  modified_base (471)..(471): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccgagggacgggaatggagtggattggtgacatccattatacgtggggcgacgtactactctccgtccctcaacgacgtcgtctcacctaatttcgngggacacggtccatcgaaccgcttcctccctagaaactgacctccgtcgaccgtccgcggacacggccgtttattctgttggcgaggcgagtactggtctttnaatcgtagtggggccttgggcctaccgttggtcttacgtcgtccttcttcacgcttccaaccaacgggcccagtccggttccttccccg

SEQ ID NO: 388813 - DNA, 591 bp, Homo sapiens
  misc_feature: GZ8MTXP01EG3BR.44.23.C01.1.454.CMB.2.raw
  modified_base (405)..(405): a, c, t, g, unknown or other
  modified_base (417)..(417): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaaacaaaaaggggggagaggcccctaaaggtcctcgtctctcgtgaaaccagactgggaagtagagtcccgtcaggttcagtgccagtccaggtggtgggcccggagtcactctcaaccattaagcgacctgcggcctagaagattcngactaaactttnttctgtacagctaagtatactagttacgtccgtccccggtttcttacgtttcggaccgaacggggaaccgaagtacgtaacggaaactaaccgaaaacgtaacgtggtggtcttcgaccaccgtacttcttcgttcttactaacttcccttcccgcctattctaagttaattaa

SEQ ID NO: 388814 - DNA, 588 bp, Homo sapiens
  misc_feature: GZ8MTXP01DI035.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactgggcgacgtactactctccgtcctcaagacgtcgtctcaccatttcgagggacacgtccatgaaccccgcttactccctagaaactcgaaccctccgtgacccgccgcggacacggccgtttatttctgtgcgaggcgagactggtctttcaattctatggggccgtggggcaccgtggtcactcgtctcctcacgtccttccaccgaacgggccccaagttccggttcccttcccccgttcgggcccgccccgttcgcccgttcccacgggaacgcccgacccgttccgttcggggggccaaccggg

SEQ ID NO: 388815 - DNA, 791 bp, Homo sapiens
  misc_feature: GZ8MTXP01D6CDA.44.23.C01.1.454.CMB.2.raw
  modified_base (240)..(240): a, c, t, g, unknown or other
  modified_base (275)..(275): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccggcgagtcgaggttcgttttcggngcttgttgccttggtttacaaacgaaaaagggggngacggacccctaaggtcctcgtctcgtcgtagaaaacccagacgtaggaaaggtacgacggtccccgtaccgaaggtttcaaggtcgaccgtaacggtcccgagggggttgggtcgggggacccggtagttccccaacttcctacccaacctaaacgtttaacggccgtaacccgttggggcccgggtaccttaagggaaacggttactttccctaggtaacctttaaaaccttttagttttcctaggtttaccaacggtacgtaagttaataccgtaattaacgttccgttacccccgtttacccggtttaaccgttttacgggttacccggtaacggggaaaccgaaacgtaccgtaaggtaaaacgttaaaccgaaaaccggtaaaccgtaggttacggaacggttacgttaccgaacccttaaacgttacgttcgtttaccgtttccttaaccttaaccctttccccgtaacccgttaccttaccgttacgttaacgttaacgttttaaacg

SEQ ID NO: 388816 - DNA, 417 bp, Homo sapiens
  misc_feature: GZ8MTXP01A8J08.44.23.C01.1.454.CMB.2.raw
  modified_base (319)..(319): a, c, t, g, unknown or other
  modified_base (376)..(376): a, c, t, g, unknown or other
  modified_base (409)..(417): a, c, t, g, unknown or other
tcagacagtatatacacgaccggtgctcgatttagtacacgtgattagggattgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaaggggaccacgggtcaccgtctcctcagcttccaccaagggcccatcggtcttccccctggcgccctgctccaggngcactctgggggcacagcggccctgggctgcccctggtcaaggactacttccctatntactgtctgagcgggctgggcaaggcgcatagnnnnnnnnn

SEQ ID NO: 388817 - DNA, 558 bp, Homo sapiens
  misc_feature: GZ8MTXP01AXDNU.44.23.C01.1.454.CMB.2.raw
  modified_base (357)..(357): a, c, t, g, unknown or other
  modified_base (399)..(399): a, c, t, g, unknown or other
  modified_base (410)..(410): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggagtttccatcagttctgatcattctgggctggatcggcagccccagggagggatggagtggattggtgacatccattatactggggcgacgtactactctccgtcctcaacgcgtcgtctcaccaatttcgnggacacgtccatgaaccgcttctccctgaaactgacctcgtnaccgcgcgacncggtctttattctgtcggcgaggcgagtactggtctttcgaatctagtggggccgttggcctaccgttgggtccacgtcgtccttccttcttacgtccctttccaacccgtacggggccccttacgtccggttcccgtttccccccgg

SEQ ID NO: 388818 - DNA, 556 bp, Homo sapiens
  misc_feature: GZ8MTXP01DZH3C.44.23.C01.1.454.CMB.2.raw
  modified_base (465)..(465): a, c, t, g, unknown or other
  modified_base (484)..(484): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatggagtggatggtgacatccattatacgtggggcgacgtactactctccgtcctcaacgagtcgtctcacctaatttcgaagggacacgtccatcgaaccgcttctccctgaaactcgacctccgtgacccgccgcggacacggtccgtttattctgtcggcgaggcgagactggtcttnaatctagtggggcctggcncccgttggtccacgtgtccttccgttcacgtccttcccaaccgtaacgggcccagtcccgttccttcccccg

SEQ ID NO: 388819 - DNA, 531 bp, Homo sapiens
  misc_feature: GZ8MTXP01D10JZ.44.23.C01.1.454.CMB.2.raw
  modified_base (221)..(221): a, c, t, g, unknown or other
  modified_base (240)..(240): a, c, t, g, unknown or other
  modified_base (272)..(272): a, c, t, g, unknown or other
  modified_base (307)..(307): a, c, t, g, unknown or other
  modified_base (440)..(440): a, c, t, g, unknown or other
  modified_base (517)..(517): a, c, t, g, unknown or other
  modified_base (526)..(526): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggngagtcaggtcgttttcggngctgttgcctggtttacaaacgaaaagggggnacggcccctaaggtccctcgtctctcgtgaaaccngactggaagtagacgtcccgtcagggttcagtgccagtccaggtggtggccccggagtcactctcaaccattgcactgcgctgaagtattctgctaacttattctgtcagcagtactcatagtcgccccgttntacgtttgcctaggggacagctaggaaactcaaacgatgtggcttgcaccatcttgttcttcaattccttcccgctnttcctgttnttaac

SEQ ID NO: 388820 - DNA, 500 bp, Homo sapiens
  misc_feature: GZ8MTXP01CEBGJ.44.23.C01.1.454.CMB.2.raw
  modified_base (336)..(336): a, c, t, g, unknown or other
  modified_base (368)..(368): a, c, t, g, unknown or other
  modified_base (379)..(379): a, c, t, g, unknown or other
  modified_base (382)..(382): a, c, t, g, unknown or other
  modified_base (408)..(408): a, c, t, g, unknown or other
  modified_base (413)..(413): a, c, t, g, unknown or other
  modified_base (418)..(418): a, c, t, g, unknown or other
  modified_base (453)..(453): a, c, t, g, unknown or other
  modified_base (466)..(466): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtccaggtgcagctgcaggagtcgggcccaggactggtgaggccttcgggaaccctgtctctcatctgcactgtctctggatttccatcagttctgatcattcttggggctggatcgcagccccagggaggaatggagtgatggtgacatcatatacgtggcgacgtactactctccgtcctcaacgagtcnctcaccaatttcgaaggacacgtccatgaacnctctccctaanacncactcgcgaccgcgcgacacgtcttntctgnggcgngcagctgtctacatctgtcggcgtgctcgttgtcncgtctcttcttcnctctccaaccgacgccgacgtccgttccgtcccg

SEQ ID NO: 388821 - DNA, 606 bp, Homo sapiens
  misc_feature: GZ8MTXP01BE65E.44.23.C01.1.454.CMB.2.raw
  modified_base (240)..(240): a, c, t, g, unknown or other
  modified_base (268)..(268): a, c, t, g, unknown or other
  modified_base (397)..(397): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcaggttcgtttcggngctgttgcctggttcaacgaaaaggggnacggcccctaaggtcctcgtctctcgtagaaaccagactggaaggtagacgtcccgtcaggttcagtgccagtccaggtggtggcccgagtcactctcaaccattcgcgacctgcggctgaagtattcngactaacttagttctgtacagcagtatcatacgtcgtccccggttctacgttttcgggaccgtaagggggaacccaaaggtcgtaaacggaaaacttaaccgaaaacggtaaaccgtggtaacggcttacggaccttaacctacgtcttcggtttcctttaccgtaacttcccctttccccggcctaacttccgttgttaactttaaag

SEQ ID NO: 388822 - DNA, 575 bp, Homo sapiens
  misc_feature: GZ8MTXP01CIN2X.44.23.C01.1.454.CMB.2.raw
  modified_base (239)..(239): a, c, t, g, unknown or other
  modified_base (270)..(270): a, c, t, g, unknown or other
  modified_base (569)..(569): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgtttcggngctgttgcctggtttcaacgaaaaagggggnaggcccctaaggtcctcgtctctcgtgaaaccagactggaaggtagagtccccgtcaggttcagtgccagtccaggtggtgggccccggagtcactctcaaccatgcgacctgcggcctgaagattctgctaacttatttctgtcagcagtatcatagtcgtccccggttctaccgttttggacccgtagggggtacccaaggtcgtagggaaacttaccgaaaacgtaacgtggttcgggcttggaccaccgtaactcttgttccttctaacttccttccccgcctacttccttaagntttaac

SEQ ID NO: 388823 - DNA, 590 bp, Homo sapiens
  misc_feature: GZ8MTXP01EY8RS.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatcgaaccccgcttctccctgaaacctgacctccgtgaccgccgcggacacggccgtttatttctgtgcgaggcgagtactggttctttcgaattctagtcggggccgttgggggctacccgtggtcactgtcctcctcacgtccttccaccgaacgggcccctaagttccgggtcctttcccccgtgggcccgccccgttcgcccttcccgacgggaacgccacccgttcgtcggggggccaaccgg

SEQ ID NO: 388824 - DNA, 534 bp, Homo sapiens
  misc_feature: GZ8MTXP01DZM77.44.23.C01.1.454.CMB.2.raw
  modified_base (222)..(222): a, c, t, g, unknown or other
  modified_base (271)..(271): a, c, t, g, unknown or other
  modified_base (394)..(394): a, c, t, g, unknown or other
  modified_base (407)..(407): a, c, t, g, unknown or other
  modified_base (422)..(422): a, c, t, g, unknown or other
  modified_base (439)..(439): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggtcgttttcggtgctgttgcctggttacaacgaaaagggggnaggcccctaaggtcctcgtctctcgtagaaaccagactggaaggtagacgtcccgtcaggttcagtgccagtccaggtggtggcccggagtcactctcaaccattgcacctgcgcctgaagtnttctgctaacttnttctgtcagcagtancatagtcgtcccggttntacttttcgaccgaggggtaccaagctaaggaaactcgaaaacgactgtggcttgcaccatcttgttcttcaatccttcccgcattctgaattaa

SEQ ID NO: 388825 - DNA, 530 bp, Homo sapiens
  misc_feature: GZ8MTXP01DXVEU.44.23.C01.1.454.CMB.2.raw
  modified_base (513)..(513): a, c, t, g, unknown or other
  modified_base (519)..(519): a, c, t, g, unknown or other
  modified_base (526)..(526): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggagaggcccctaaggtcctcgtctctcgtgaaaccagactggaaggtagagtcccgtccaggttcagtgccagtccaggtggtggccggagtccactctcaccaattagcgacctgcggcctgaagattctgctaacttattctgtcagcagtatcatagtgccccgtttctacttttggcctagggggaccaagctaggaaaatcaaacgactagtggctgcaccatctgttcttcactcttccnccatcngtaattntaac

SEQ ID NO: 388826 - DNA, 565 bp, Homo sapiens
  misc_feature: GZ8MTXP01CZFFF.44.23.C01.1.454.CMB.2.raw
  modified_base (361)..(361): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggatggagtggattggtgacatccattatactgggggcgacgtactactctccgtcctcaacgagtcgtctcacaatttcgnggacacgtccatcgaaccgcttctccctgaaactcgacctccgtgaccgccgcggacacggcgtttattctgtcggcgaggtccgagactggtctttcaatctagtcggggccgtggcctacccgttggttccacgttcgtcttcccgttcacgtccttacccaaccgtaacgggccccttatcccgggttcctttccccccgg

SEQ ID NO: 388827 - DNA, 576 bp, Homo sapiens
  misc_feature: GZ8MTXP01DAA3B.44.23.C01.1.454.CMB.2.raw
  modified_base (347)..(347): a, c, t, g, unknown or other
  modified_base (514)..(514): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgtggggctggatccggcacgccccgagggagggaatggagtggagttggtgacatccattatacgtgggcgtacgtactactctccgtcctcaacgngtcgtctcacctaatttcgaagggacacgtccatacgaaccgtcttcctccctagaaactcgacctcgtacgaccgccgcgacgacggtccgtttattcgtgtggcggtaggcgagtacgtggttctttcaaattcgtagtcggggccgtggcctaccgttggtacncgttcgtccttccttcacgtccttaccgaaccgaacggtcccagttccgttccctttccccg

SEQ ID NO: 388828 - DNA, 555 bp, Homo sapiens
  misc_feature: GZ8MTXP01BLOQ1.44.23.C01.1.454.CMB.2.raw
  modified_base (272)..(272): a, c, t, g, unknown or other
  modified_base (307)..(307): a, c, t, g, unknown or other
  modified_base (549)..(549): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaacgaaaagggggnacggcccctaaggtcctcgtctctcgtagaaaccngactggaagtagagtcccgtcaggttcagtgccagtccaggtggtgggcccgagtcactctcaaccattcgcgacctgcggctgaagtacttctgactaacttattctgtcagcagtatcatagtcgccccggttctacgttttcggaccgtaggggaccaagcgtagggaaatcgaaacgtacgtgtcggcttcgcaccgatcttgttcttccaattccttccccgcctacttctaagttnttaacg

SEQ ID NO: 388829 - DNA, 433 bp, Homo sapiens
  misc_feature: GZ8MTXP01AHLPT.44.23.C01.1.454.CMB.2.raw
  modified_base (256)..(256): a, c, t, g, unknown or other
  modified_base (294)..(294): a, c, t, g, unknown or other
  modified_base (306)..(306): a, c, t, g, unknown or other
  modified_base (423)..(433): a, c, t, g, unknown or other
tcagacagtatatacacgaccggtgctcgatttagtacacgtgattagggattgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtcncctcagcctcaccaaggcccatcggtctcccctggccncctgctccaggngccaccgtccgagagcacacggccggcccgtgggcctcggcccctgggtcaagggtacctacgttaccctataactactgtactggacggcggggctgggccaagggcgacagtagnnnnnnnnnnn

SEQ ID NO: 388830 - DNA, 644 bp, Homo sapiens
  misc_feature: GZ8MTXP01ECGAD.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctatttcgttggggctggactccggcacgcccccgaggggaggggaagtgggaggtggtagttggtgaacatcctattatacgtggggacgtacgtactactcctcccgtccctacaagtacgtcgtctccacctatttcggagggactacgtccatacgaaccccgtcttctaccctagaaactcgaccctcgtcgacccgccgcgctacggtcttattctgtgcgaggcgagacgtggttcttacaattctaggtcgggtccgtggggcctaccgttggcctcgttcgtccttcctcgtacgtccttacccaaccgaaccgggcccctacggttcccgggttcccctttcccccgtcgggtcccccgttccccgttcgcccgtccggacgggtccgcccgtaccggttcgggtccggggccgtaacgg

SEQ ID NO: 388831 - DNA, 575 bp, Homo sapiens
  misc_feature: GZ8MTXP01DSFO0.44.23.C01.1.454.CMB.2.raw
  modified_base (557)..(557): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggaggggaatgggagtggattggtgacatccattatacgtgggcgacgtactactctccgtccctcaagacgtcgtctcacctatttcgaggacacgtcatcgaaccccgcttctccctagaaacctcgacctccgtcgacccgccgcggacacggtcgtttattcgtgtgcgaggcgagtacgtgttcttacattcgtacggtcgggtccgtcggggcctacgttcgtactcgtcgtcctcctactcgtcctaccgacgacgcctcgttccgtcccttcccgcgccttccgttcgaccgtccgagcgacnccgttgtcggcgaaccgg

SEQ ID NO: 388832 - DNA, 556 bp, Homo sapiens
  misc_feature: GZ8MTXP01AZ72A.44.23.C01.1.454.CMB.2.raw
  modified_base (271)..(271): a, c, t, g, unknown or other
  modified_base (552)..(552): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnaggcccctaaggtcctcgtctctcgtagaaaccagactggaaggtagacgtcccgtcaggttcagtgccagtccaggtggtgggccccggagtccacgtctcaaccattgcgacctgccggctgaagattctgctacttatttctgtcagctagtatcatagtcgtccccggttctacgttttcggaccgagggggtaccaagccgttaggaaactacgaaaacgactggtaaggcttgaccacgatccttgttcttcaactcctccgctcttgtaacttntaac

SEQ ID NO: 388833 - DNA, 558 bp, Homo sapiens
  misc_feature: GZ8MTXP01A1Q11.44.23.C01.1.454.CMB.2.raw
  modified_base (222)..(222): a, c, t, g, unknown or other
  modified_base (240)..(240): a, c, t, g, unknown or other
  modified_base (271)..(271): a, c, t, g, unknown or other
  modified_base (552)..(552): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggnagtcaggtcgttttcggngctgttgcctggtttacaacgaaaagggggnaggcccctaaggtcctcgtctctcgtagaaaccagactggaagtagacgtcccgtcaggttcagtcgccagtccaggtggtggccccggagtccactctcaaccatgcgacctgcgctagaagtatctgctacttattctgtcagcagtatcatagtcgtccccgggttctacgttttcggaccgagggggaccaacgcttaagggaaactacaaaacgaaccttggaacggcttaggccacgtactcttgttcttctaatccttaacccactattctaanaattaa

SEQ ID NO: 388834 - DNA, 562 bp, Homo sapiens
  misc_feature: GZ8MTXP01DK13M.44.23.C01.1.454.CMB.2.raw
  modified_base (222)..(222): a, c, t, g, unknown or other
  modified_base (273)..(273): a, c, t, g, unknown or other
  modified_base (307)..(307): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggnagtcaggttcgtttcggtgctgttgcctggtttacaaacgaaaaggggganacggcccctaaggtcctcgtctctcgtgaaaccngactggaagtagacgtcccgtcaggttcagtgcagtccaggtggtcgggccccggagtccactctcaaccattcgcgacctgccggcctggaagtattctgctaacttattctgtacagcagtatcatacgtcgtcccggttctacgttttcggccgtagggggacccaaggcgtacggtaaactacaaacgactggtaacgcttgcacctatcttcgttcttcaacttccttcccgtccattcctgttaattaa

SEQ ID NO: 388835 - DNA, 556 bp, Homo sapiens
  misc_feature: GZ8MTXP01B7SLJ.44.23.C01.1.454.CMB.2.raw
  modified_base (520)..(520): a, c, t, g, unknown or other
  modified_base (527)..(527): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggccccaggactggtgaggccttcgggaaccctgtctctcatctgcactgtctctggagtttccatcagttctgatcattcttggggctggatccggcagcccccgagggaggggaatgggagtggattggtgacatccattatactgggcgacgtactactctccgtccctcaagactcgtctcaccatttcgagggacacgtccatcgaacccgcttctccctgaaactgaccctccgtgacccgccgcggaccacgggtccttatttctgtgcgaggcgagacttggtctttcgaattcgtagtggggccgtggggcaccgtggtcactgtctcctcagtccttccaccaacggcccattccggtccttccccgtggccncccgttncctcagtcgcaccgttcgtcggggcaacg

SEQ ID NO: 388836 - DNA, 640 bp, Homo sapiens
  misc_feature: GZ8MTXP01C7HZU.44.23.C01.1.454.CMB.2.raw
  modified_base (238)..(238): a, c, t, g, unknown or other
  modified_base (270)..(270): a, c, t, g, unknown or other
  modified_base (403)..(403): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgccttggtttcaaacgaaaagggggngaggcccctaaggtcctcgtctctcgtgaaaccagactggaagtagagtcccgtcaggttcagtgcagtccaggtggtggccggatccactctcaccattagcgactgcgctgaagatctgctaacttattcngtcagcagtatcatagtcgtccccgtttgtaacgtttttcgggacccgtaacgggggaacccaaaaggtcccgttaaggggaaaaacttaccgaaaaaaccggtaaacccgttgggttaacggggccttacgggccaaaccccgaatttcccgtaacggtttcccgtttccgaaaccgttttcccctttaccccggccccttaaattccctttacggtaactttaagtttaaacccg

SEQ ID NO: 388837 - DNA, 597 bp, Homo sapiens
  misc_feature: GZ8MTXP01EHFFJ.44.23.C01.1.454.CMB.2.raw
  modified_base (549)..(549): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggaggggaagtggagtggagttggtgacatccattatacgtgggcgacgtactactctccgtcctcaagagtcgtctcacctatttcgagggacacgtccatcgaaccccgcttctccctagaaactcgacctccgtcgacccgccgcggacacggtccgtttattctgtgcgaggcgagtacgttggttcttcaatcgtagtcggggtccgtcgggggcctacccggttggtcctacgtcgtcctcctcacgtccttcccaccgaacgggccctagttccggtcccttccccgtcgggcccncccgttcgcctcccgaggccgcctaccggttcggtcgggggcaaccgg

SEQ ID NO: 388838 - DNA, 544 bp, Homo sapiens
  misc_feature: GZ8MTXP01A0O8S.44.23.C01.1.454.CMB.2.raw
  modified_base (241)..(241): a, c, t, g, unknown or other
  modified_base (271)..(271): a, c, t, g, unknown or other
  modified_base (396)..(396): a, c, t, g, unknown or other
  modified_base (442)..(442): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttttggngctgttgcctggttacaacgaaaagggggnacggcccctaaggtcctcgtctctcgtgaaaccagactggaaggtagagtccccgtcaggttcagtgccagtccgaggtggtgggccccgagtccactctcaaccattgcacctgcggctgaagnttctgctaacttattctgtcagtcagtatcatagtcgccccggttnacgtttggacctaggggaccaaggctaggaaatcgaaacgtactgtcgggcttggaccacgatcttcgttcttacaactccttcccgctattctgaacttaa

SEQ ID NO: 388839 - DNA, 629 bp, Homo sapiens
  misc_feature: GZ8MTXP01EPFX6.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggaggggaatgggagtggattggtgacatccattatacgtgggcgacgtactactctccgtccctcaagatcgtctcaccatttcgagggacacgtccatcgaaccccgcttctccctgaaactcgacctccgtcgaccgccgcggactacgggtccgtttatttctgtgcggaggcgagtactggtctttacaattctagtggggccgtgggggcctacccgtggtccacgttcgtccttcctcgacgtccttacccgacccgaaacggggcccctaacgttccggggttcccctttccccccgtggggtcccccgttccccgttcgcccgtcccggacggtaaccgcccgtacccggttccgggtccgggggcccgtaaccgg

SEQ ID NO: 388840 - DNA, 630 bp, Homo sapiens
  misc_feature: GZ8MTXP01BZT23.44.23.C01.1.454.CMB.2.raw
  modified_base (222)..(222): a, c, t, g, unknown or other
  modified_base (241)..(241): a, c, t, g, unknown or other
  modified_base (276)..(276): a, c, t, g, unknown or other
  modified_base (434)..(434): a, c, t, g, unknown or other
  modified_base (445)..(445): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggnagtcaggttcgttttcggngcttgttgccttggtttacaaacgaaaaggggganacggcccctaaggtccctcgtctctcgtagaaaccagactaggaaggtagacgtcccgtacgaggttcagtcgccagtccagggtggtggggccccggagtcacgtctcaaccattgcgaccgtgcgcctagaaagtacttctgactaacttatttcngtcagcagtancatagtcgcccgttctacgtttcggaccgtaggggacccaaagcgtaaacggtaaactaccgaaaaacgtaccgtggtaacggtcttcgaccaaccgtacttcctttacggttcctttacccgtaacctttcccctttaaccccggccccttaaattcccggtttaagttaaccgttttaaaacg

SEQ ID NO: 388841 - DNA, 565 bp, Homo sapiens
  misc_feature: GZ8MTXP01DG77L.44.23.C01.1.454.CMB.2.raw
  modified_base (542)..(542): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccgcagccccagggagggaatggagtggatggtgacatccattatactggggcgacgtactactcctccgtccctcaagagtcgtctcaccatttcgagggacacgtccatcgaaccccgcttctccctagaaactgaccctccgtgacccgccgcggacacggcgtttattctgtgcgagcgagacgttggtctttcaatctaagtggggccgtggggccaccgtcggtcacgtgtctcctcagtccttccacctaagggccctaagttccggttccttcccccgttggcccgcccgttcgcctccgagaacnccgaccttcgtcgggggcaaccg

SEQ ID NO: 388842 - DNA, 608 bp, Homo sapiens
  misc_feature: GZ8MTXP01EZHNJ.44.23.C01.1.454.CMB.2.raw
  modified_base (421)..(421): a, c, t, g, unknown or other
  modified_base (489)..(489): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgaggggaggggaagtgggagtggagttggtgacagtccattagtacgtggggcgacgtactactctccgtccctcaagagtcgtctcacctagtttcgacggacacgtcatcgaaccccgtcttctcctagaaactcgacctccgtgaccgccgcgacacggtctttattctgtgcgnggcgagtacgtggttcttcgaatcgtagtgggccgtggggcctaccgtggtcacgtcgtcctcccgtnacgtcctccgaaccgaacgggcccctacgttcccggtcccctttcccccgtcggcccgttccccgttcgcccgtaaccgacggaaccgtccgacccgttcgggtcgggggcaacccggg

SEQ ID NO: 388843 - DNA, 604 bp, Homo sapiens
  misc_feature: GZ8MTXP01DUHQJ.44.23.C01.1.454.CMB.2.raw
  modified_base (317)..(317): a, c, t, g, unknown or other
  modified_base (362)..(362): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcatttcttggggctggatccggcagcccccgaggggaggggaatgggagtggattggtgacatccattatactggggcgacgtactactctccgtccctcaagngtcgtctcacctatttcgagggacacgtcatcgaaccccgcttcnccctagaaactcgaccctccgtcgacccgccgcggacacggtccgttttattctgtgcgaggcgagtactggttcttcaatctagtggggccgtggggctacccgtggtcactcgtctcctcacgtccttaccaccgaaacgggtccccaacgttcccgggttccctttccccccgttggccccgttccccgttcgcccgtcccgacggaacgcccacccgttcggtcgggggcaacccggg

SEQ ID NO: 388844 - DNA, 557 bp, Homo sapiens
  misc_feature: GZ8MTXP01D0WPT.44.23.C01.1.454.CMB.2.raw
  modified_base (362)..(362): a, c, t, g, unknown or other
tcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagccccagggagggaatggagtggatggtgacatccattatacgtggggcgacgtactactctccgtccctcaacgagtcgtctcacctaatttcgngggacacgtccatcgaaccgcttctccctgaaactgacctccgtgacccgccgcgacacggccgtttattctgtcgcgaggcgagacttggtctttcgaaatcgtagtcggggccgtgggcctacccgttggtcacgtgtcttccgttcacgtcctttaccaaccgtaacgggcccagtccgttcctttcccccg

SEQ ID NO: 388845 - DNA, 597 bp, Homo sapiens
  misc_feature: GZ8MTXP01A3JU9.44.23.C01.1.454.CMB.2.raw
  modified_base (274)..(274): a, c, t, g, unknown or other
  modified_base (395)..(395): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgaggggaggggaatggagtggattggtgacanccattatacgtgggcgtacgtactactctccgtcctcaagactcgtctcacctatttcgacggacacgtcatcgaaccccgcttctccctagaactcgacctccgtcgacccgccgcgacncggtcctttattctgtgcgagtcgagtacgttgttcttacaattcgtagtcggggtccgtggggccctacccgttggtcctacgttcgtcccttccgtcacgtccttacccgaccgaacgggccctacgttccggttcccttccccgtgcccgttccccgttgccctcgaggtccgcctaccgttcggtcggggccaaccgg

SEQ ID NO: 388846 - DNA, 652 bp, Homo sapiens
  misc_feature: GZ8MTXP01CEK84.44.23.C01.1.454.CMB.2.raw
  modified_base (597)..(597): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgcccccgaggggacgggaatggaggtggtagttggtgactatacctagttatacgtgggggacgtaacgtaccttactccgtcccgtccctacgtaacgtacggtcgtctccaacctaacgtttcggaacggacctaccgtaccacgtacgaacccgtcttacctcccgtagtaaacctcgtaccctccgtcgacccgcgacgaccgaccggtcgtttactctgtcggcggtaggcgagtacgttcggtcctttacgaacttcgtagtcgggtcgttggaaccctcgttcggtcacgtcgtccttccttcgacgtccttacccaacncccggggttaaccccttacggtttaaccccggttccccgttttaaccccccgggg

SEQ ID NO: 388847 - DNA, 526 bp, Homo sapiens
  misc_feature: GZ8MTXP01CZ4AT.44.23.C01.1.454.CMB.2.raw
  modified_base (275)..(275): a, c, t, g, unknown or other
  modified_base (352)..(352): a, c, t, g, unknown or other
  modified_base (387)..(387): a, c, t, g, unknown or other
  modified_base (389)..(391): a, c, t, g, unknown or other
  modified_base (397)..(397): a, c, t, g, unknown or other
  modified_base (401)..(401): a, c, t, g, unknown or other
  modified_base (512)..(512): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttacaaacgaaaaagggggnaggcccctaaggtcctcgtctctcgtgaaacagactggaaggtagagtcccgtcaggttcagtgccagtccaggtgngggcccgagtcatctcaacatgcgactgcgctgantnnnattatntgtnagcagtatctatagtcgtcccgttctacgttttcggaccgtaggggaccaagctaggaaatcaaacgaactggtggcttgccacgtatcttgttcttctaattccttcccnctattctgaattaa

SEQ ID NO: 388848 - DNA, 579 bp, Homo sapiens
  misc_feature: GZ8MTXP01E3IVL.44.23.C01.1.454.CMB.2.raw
  modified_base (356)..(356): a, c, t, g, unknown or other
  modified_base (438)..(438): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgtgggctggatccggcagctccgagggagggaatggagtggattggtgacatccattagtacgtggggcacgtactactctccgtcctcaagtgtcgtctcaacctnttcgaggtacacgtcagtcgaaccgtcttccacctagaaactcgacctcgtacgaccgccgacggactacggtcctttatcnggtgcgtagcgtagtacgttcggttactttacaagttcgtaggtcggggccttggccttaacccgtggttactacgttcggttccttccgttacaacgtccttaaccgaaccgtaagggcccctaagttcccggttccccg

SEQ ID NO: 388849 - DNA, 561 bp, Homo sapiens
  misc_feature: GZ8MTXP01BIIG5.44.23.C01.1.454.CMB.2.raw
  modified_base (366)..(366): a, c, t, g, unknown or other
  modified_base (427)..(427): a, c, t, g, unknown or other
  modified_base (441)..(441): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggagggaatggagtggattggtgacatccattatacgtggggcgacgtactactctccgtcctcaacgagtcgtctcacctaatttcgngggacacgttccatcgaaccgtcttcctccctgaaactgaccctcgtcgaccgccgcgacncggtcttattctgngcgaggcgagactggtcttcaatcgtagtcggggccgtgggcctacccgttgggtcacgtcgtcttccttcgacgtccttcccgaaccacgggtcccacgtcccggttcctttcccccgg

SEQ ID NO: 388850 - DNA, 407 bp, Homo sapiens
  misc_feature: GZ8MTXP01BFXB5.44.23.C01.1.454.CMB.2.raw
  modified_base (301)..(301): a, c, t, g, unknown or other
  modified_base (313)..(313): a, c, t, g, unknown or other
  modified_base (367)..(367): a, c, t, g, unknown or other
  modified_base (397)..(397): a, c, t, g, unknown or other
  modified_base (399)..(399): a, c, t, g, unknown or other
  modified_base (401)..(407): a, c, t, g, unknown or other
tcagacagtatatacacgaccggtgctcgatttagtacacgtgattagggattggcagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtcgtgggggccaaggggaccacggtcaccgtctcctcagctccacaaggcccatcggtctcccctgcnccctgctcagancacctctgggggcacagcggccctgggctcgcctggtcaaggactaacttcctntatactgtctgagcgggctggcaaggcganangnnnnnnn

SEQ ID NO: 388851 - DNA, 608 bp, Homo sapiens
  misc_feature: GZ8MTXP01EGLPI.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggaggggaatggagtggattggtgacatccattatacgtgggcgacgtactactctccgtccctcaagacgtcgtctcacctatttcgaggacacgtcatcgaaccccgcttctccctgaaactcgaccctccgtgacccgccgcgaccgcggtctttattctgtgcgaggccgagtacgtggtctttcaatcgtagtcggggccgtcggggctacccgtggtcacgtcgtcctcctcacgtccttcccaaccgaacgggcccacgttcccgggtcccttcccccggtcggtcccgttccccgttcgacccgttcccgacggtaacgccccgtacccgttccggtaaccgggggccaaccggg

SEQ ID NO: 388852 - DNA, 563 bp, Homo sapiens
  misc_feature: GZ8MTXP01BFBQB.44.23.C01.1.454.CMB.2.raw
  modified_base (297)..(297): a, c, t, g, unknown or other
  modified_base (364)..(364): a, c, t, g, unknown or other
  modified_base (520)..(520): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccgagggagggaatggagtggatggngacatccattatacgtgggcgacgtactactctccgtccctcaacgagtcgtctcacctaatttcgngggacacgtccatcgaaccgcttctccctagaaactcgacctccgtgacccgcgcgacacggtcgtttattctgtggcgtaggcgagactggtcttacgaatcgtagtcggggccgtggccgtacccgttggtccacgtcgttccttccttcgacnccttcccaacgaacgggccccagttcccggttccttcccccgg

SEQ ID NO: 388853 - DNA, 558 bp, Homo sapiens
  misc_feature: GZ8MTXP01AZVW7.44.23.C01.1.454.CMB.2.raw
  modified_base (528)..(528): a, c, t, g, unknown or other
  modified_base (551)..(551): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgtagctgcaggagtcgggcccaggactggtgaggccttcgggaaccctgtctctcatctgcactgtctctggagtttccatcagttctgatcattcttggggctggatccggcagcccccgagggaggggaatgggagtggattggtgacatccattatactggggcgacgtactactctccgtccctcaagagtcgtctcaccatttcgaggacacgtccatgaaccgccttctcctgaaactgaacctccgtgacccgccgcggacacggcctttattctgtgcgaggcgagactggtctttcgaatcctagtcggggccgtggcgacccgtggtcactcgtctcctcagccttccaccaacgggcccaactcggttcctccccgttgcccgccttcgcttccgnggacgccacctcgttcgggggcncgaacgg

SEQ ID NO: 388854 - DNA, 595 bp, Homo sapiens
  misc_feature: GZ8MTXP01DX5MM.44.23.C01.1.454.CMB.2.raw
  modified_base (315)..(315): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgcccccgagggagggaatgggagtggattggtgacagtccattatacgtgggcgacgtactactctccgtccctcaagngtcgtctcacctatttcgagggacacgtccatcgaaccccgcttactccctagaaacctcgaccctccgtcgacccgcccgcgacacggtcgtttattcctgtgcgaggcgagacgtggttcttcaatccgtagcggggtccgtcggggcacccgttcggtctacgtcgtctcctacacgtccttacccaccgaacgggccctacgttccggttccttccccgttcggcccgcccgttcgacctccgacggaacgcccaccgttcgtcgggggcaaccgg

SEQ ID NO: 388855 - DNA, 564 bp, Homo sapiens
  misc_feature: GZ8MTXP01B8128.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgtgggctggatccggcacgccccgagggagggagtggagtggatggtgacatcattatacgtgggacgacgtactactctccgtcctacaacgtatcgtctcacctattcgaagggacacgtccatcgaaccgtcttcctccctagaaactcgaccctccgtcgacccgccgacggaccgaccgttccgtttattcgtgtggcgaggcgagtactgtcttctaatcgtagtcgggtccgtcggcctaccgttggtcacgtcgtcttccttcacgtcctaccaaccgacggcccttacgtccggttcctccccg

SEQ ID NO: 388856 - DNA, 574 bp, Homo sapiens
  misc_feature: GZ8MTXP01ESOLM.44.23.C01.1.454.CMB.2.raw
  modified_base (222)..(222): a, c, t, g, unknown or other
  modified_base (242)..(242): a, c, t, g, unknown or other
  modified_base (275)..(275): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggttcgttttcggngcttgttgcctggtttacaaacgaaaagggggnacggcccctaaggtcctcgtctctcgtagaaaccagactgggaaggtagacgtcccgtcaggttcagtgccagtccagggtggtgggccccggagtccactctccaaacccattaacgccgaacctcggccggccttaggaagtacttctgtactaactttattctgttacagtcagtatcattacgtcgtcccggtttctacgtttcggccgaggggaccagcgtaggaaactacaaacgactggtggcttgccacatcttcgttcttcaattccttcccgctattctgttaacttaa

SEQ ID NO: 388857 - DNA, 732 bp, Homo sapiens
  misc_feature: GZ8MTXP01AV44E.44.23.C01.1.454.CMB.2.raw
  modified_base (240)..(240): a, c, t, g, unknown or other
  modified_base (272)..(272): a, c, t, g, unknown or other
  modified_base (308)..(308): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttgaggcagcgtcaccatcacttgccgggcgagtcaggtcgttttcggngctgttgcctggtttacaaacgaaaagggggnaggcccctaaaggtcctcgtctcgtcgtagaaaccngactggaagtagacgtcccgtcaggttcagtcgccagtccgagggtggtcgggccccggagtccacgttctcaaaccctattaacggccgaacccgttgggcccgggtcccttagggaaaacgttaactttccgtacggtacctaaaacgttttactttcctaggttccaaaggtcctaaaggttacttacctaattaacggttccggtcccccggggtttataacccggtttttcgggaacccgtaacggggggaacccaaaggtccgttaaaggggaaaacttaccgaaaaaaccggtaaaccgttgggttaacggggaccttcggacccaaccccgtaaagttccttacggttccctttacctaacgtttcccctttaacccccgggcctaaacgtttccctaagttaaccgttttaaacg

SEQ ID NO: 388858 - DNA, 543 bp, Homo sapiens
  misc_feature: GZ8MTXP01EZTY2.44.23.C01.1.454.CMB.2.raw
  modified_base (429)..(429): a, c, t, g, unknown or other
  modified_base (496)..(496): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctgggctgatcgcagccccagggagggatggagtggattggtgacatccattatacgtggggcgacgtactactctccgtccctcaacgagtcgtctcacctaatttcgaagggacacgtccatcgaaccgcttctccctgaactgacctccgtgaccgccgcggacacggtccttattcngtcggcgaggcgagacctggtctttcaatctagtcggggccgtggccacccgttgggtcacgtgtcnccttcacgtccttccaacctaacgggcccatccggttccttcccccg

SEQ ID NO: 388859 - DNA, 582 bp, Homo sapiens
  misc_feature: GZ8MTXP01DWCX9.44.23.C01.1.454.CMB.2.raw
  modified_base (273)..(273): a, c, t, g, unknown or other
  modified_base (307)..(307): a, c, t, g, unknown or other
  modified_base (411)..(411): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcaggtcgtttcggtgctgttgcctggtttacaaacgaaaaaggggganaggcccctaaggtccctcgtctctcgtgaaaccngactggaagtagagtcccgtcaggttcagtgccagtccaggtggtgggcccgagtcactctcaaccattcgcgacctgcggcctgaagtattctgactaacttntttctgtacagtcagtatacatagtcgtccccggtttctaacgttttcgggacccaagggggtacccaaggtcctaagggaaactaccgaaaacgtaactggtaacggcttggaccacctaagtcttgttccttctaacttccttaacccgcctattccttgaatttaacg

SEQ ID NO: 388860 - DNA, 413 bp, Homo sapiens
  misc_feature: GZ8MTXP01DGW7K.44.23.C01.1.454.CMB.2.raw
  modified_base (319)..(319): a, c, t, g, unknown or other
  modified_base (377)..(377): a, c, t, g, unknown or other
  modified_base (409)..(413): a, c, t, g, unknown or other
tcagacagtatatacacgaccggtgctcgatttagtacacgtgattagggattgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaaggggccacggtccaccgtctcctcagcttccaccaagggcccatcggtcttccccctggcgccctgctccaggngcacctctgggggcacagcggccctgggctgcccctggtcaaggactacttccctatntactgtctgagcgggctggcaaggcgcatagnnnnn

SEQ ID NO: 388861 - DNA, 568 bp, Homo sapiens
  misc_feature: GZ8MTXP01D8O9L.44.23.C01.1.454.CMB.2.raw
  modified_base (514)..(514): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggagggaatggagtggattggtgacagtccattatacgtggggcgtacgtactactctccgtccctcaacgacgtcgtctcacctaatttcgaagggacacgtccatcgaaccgcttcctccctgaaactcgacctcgtcgaccgccgcgacacggtccgttattctgtggcgaggcgagtactggtctttcgaatcgtagtcgggccgtggccaccgttggtcttacgtcgtcnccttcaccgtccttccaaccgaacgggtcccacgtcccggttcctttcccccgg

SEQ ID NO: 388862 - DNA, 561 bp, Homo sapiens
  misc_feature: GZ8MTXP01BAVSM.44.23.C01.1.454.CMB.2.raw
  modified_base (521)..(521): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggaggggaatgggagtggattggtgacatccattatactggggcgacgtactactctccgtccctcaagagtcgtctcaccatttcgagggacacgtccatcgaaccccgcttctccctagaaacctcgaccctccgtcgacccgccgcggacacggtcgtttattctgtgcgaggcgagacttggtcttcaatctagtcggggcctgggggcaccgtggtcacgtgtctctcacgtcctccaccgaagggccccagttccggtccttccccgtggccncccgttgcctccaggcgcaccgttcgtcgggggcaaccgg

SEQ ID NO: 388863 - DNA, 608 bp, Homo sapiens
  misc_feature: GZ8MTXP01BU29X.44.23.C01.1.454.CMB.2.raw
  modified_base (411)..(411): a, c, t, g, unknown or other
  modified_base (440)..(440): a, c, t, g, unknown or other
  modified_base (545)..(545): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggccaggactggtgaggccttcgggaaccctgtctctcatctgcactgtctctggagttccatcagttctgatcattcgttgggctggatccggcacggccccgagggagggaatggagtggagttggtgacatccattagtacgtgggcacgtactactctccgtcctacaagagtcgtctcactatttcgaggacacgtccatcgaaccccgtcttactcctagaaacctcgaaccctccgtgacccgccgacgacacggtcgtttattcngtcgacgaggcgagtaccgtggtctttanaacttcgtagtcgggcctgggggacctacccgtggtacacgttcgcctctacacgtccttaccgaccgaacgggccctaacgttccccgggttcctttcccccgngggttcccccgcccgttcgccgtccgacggtaaccgccgtaccgttcgggtccgggcgaaccg

SEQ ID NO: 388864 - DNA, 600 bp, Homo sapiens
  misc_feature: GZ8MTXP01EGMIH.44.23.C01.1.454.CMB.2.raw
  modified_base (448)..(448): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgtggggctggatccggcacgcccccgagggagggaagtggagtggattggtgacatccattatacgtggggcgacgtactactctccgtcctcaacgagtcgtctcacctaatttcgaagggacacgtcatcgaaccgtcttctccctagaaactcgacctcgtcgacccgcgcgaccacggtcccgtttattccngtcgggtcgaggtcgagtacgtggttctttccaaagttccttaaggtcggggtccgtggcacccgttgggtccttacgtcgtcccttccgttcttacggtcccttccgaaccgtaacggggtccccacgttcccggttcccttccccccggg

SEQ ID NO: 388865 - DNA, 572 bp, Homo sapiens
  misc_feature: GZ8MTXP01A7PJS.44.23.C01.1.454.CMB.2.raw
  modified_base (526)..(526): a, c, t, g, unknown or other
  modified_base (551)..(551): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggaggggaatgggagtggattggtgacatccattatacgtggggcgacgtactactctccgtccctcaagagtcgtctcaccatttcgagggacacgtccatcgaaccccgcttctccctagaaacctcgacctccgtgaccgccgcggacacggtccgtttattctgtgcgaggcgagactggtctttcgaatctagtggggccgtggggcaccgtggtcactcgtctcctcacgtccttccaccaacgggcccacgttccggtccttcccccgtggcccncccgttcgcctcccgaggaacgccnccgttcgtcgggggcaaccgg

SEQ ID NO: 388866 - DNA, 645 bp, Homo sapiens
  misc_feature: GZ8MTXP01DSQ13.44.23.C01.1.454.CMB.2.raw
  modified_base (240)..(240): a, c, t, g, unknown or other
  modified_base (274)..(274): a, c, t, g, unknown or other
  modified_base (312)..(312): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgtttcggngtctgttgcctggtttacaaacgaaaaggggganacggacccctaagggtcctcgtctctacgtagaaaccngactgggaaaggtagacgtcccgtcaggttcagtgccagtccaggtggtgggccccggagtcactctcaaccattaagcgacctgcggcctagaagtacttctgactaacttatttctgtacagtcagtatcaatacgtacgtcccggtttctacgttttcggacccgtaacgggggaaccaacggacgttaagggaaacttaacgtaaaacgtaaaccgttggtaacgggtcgttacggtacccaaaccgtaacgttcgttcgtttccctttaccgttaaccttccccttttccccggacccctaagttccttaacggttaacttttaaacg

SEQ ID NO: 388867 - DNA, 608 bp, Homo sapiens
  misc_feature: GZ8MTXP01EVPPT.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggaggggaatggagtggattggtgacatccattatacgtggggcgacgtactactcctccgtccctcaagagtcgtctcacctatttcgaggacacgtcatcgaaccccgcttctccctagaaacctcgaaccctccgtcgacccgcccgcggaccgtacggtccgtttattcgtgtgcgaggcgagtactggttcttacaatcgtagtcgggccgtggggctaccgtggtcacgtcgtcctcctcgacgtccttacccgacccgaaacgggcccctacgttcccgggtcccttcccccgtcgggtcccgcccgttcgcctcccgacggaacgtcccacccgttcggtcgggggccaacccggg

SEQ ID NO: 388868 - DNA, 591 bp, Homo sapiens
  misc_feature: GZ8MTXP01ALXPQ.44.23.C01.1.454.CMB.2.raw
  modified_base (526)..(526): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggatccggcacgcccccgagggacgggaatggagtggattggtgacatccattatacgtgggcgacgtactactctccgtcctcacgagtcgtctcacctaagtttcgaagggtaccacgtccagtcgaaccgtcttacctccctagaaacctcgaccctcgtcgacccgccgcgacacggttcgtttattcgtgtcggcgacgggcgacgtacgttggttcctttacgaattcgtaggtcggggtccgtcggcctcccgttggtccncgttcgtccttccgttcacgtccttccaaccgaccggcccttacgttcccggttcccttccccgg

SEQ ID NO: 388869 - DNA, 570 bp, Homo sapiens
  misc_feature: GZ8MTXP01ELX9H.44.23.C01.1.454.CMB.2.raw
  modified_base (373)..(373): a, c, t, g, unknown or other
  modified_base (456)..(456): a, c, t, g, unknown or other
  modified_base (473)..(473): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggaggggagtggaggtggagttggtgacatccattatacgtggggcgacgtactactctccgtccctcaacgagtcgtctccacctaatttcgngggacacgtccatcgaaccgcttcctccctagaaactcgacctccgtgacccgccgcgacacggtccgtttattctgtggcgnggcgagtacgtgtcttnaactcgtagtggggccgtcggcaccgttggtccacgtcgtccttccttcacgtccttcccaaccgaacggtcccacgtcccggttcccttcccccgg

SEQ ID NO: 388870 - DNA, 647 bp, Homo sapiens
  misc_feature: GZ8MTXP01CJB5R.44.23.C01.1.454.CMB.2.raw
  modified_base (275)..(275): a, c, t, g, unknown or other
  modified_base (367)..(367): a, c, t, g, unknown or other
  modified_base (372)..(372): a, c, t, g, unknown or other
  modified_base (422)..(422): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgattcatttcgttggggctggactccggcacgccccgaggggagggaatgggagtggtagttggngacatcattatacgtgggcgtacgtactactctccgtcctacaagcgtcgtctcacctatttcgacggacacgtcatcgaaccccgtcttcncctanaaactcgacctccgtcgaccgccgcgacacggtcttacttcgtgtcgcgngcgtagacgttcgttcttcaattcgacgttcggggccgtcggggcctacccgttgggtacctacgtcgtccttccgtactacgtcccttacccgaacccgtaaccggggtccctaacgttcccgggttccccttcccccggtcggtccccgttccccgttcgccccgttaacccgaaagggccctcccgtacccgttccgggttaacgggggccctaacccgggg

SEQ ID NO: 388871 - DNA, 668 bp, Homo sapiens
  misc_feature: GZ8MTXP01EQAYO.44.23.C01.1.454.CMB.2.raw
  modified_base (348)..(348): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcagcccccgagggagggatggagtggattggtgacatccattatacgtggggcgacgtactactctccgtccctcaacgngtcgtctcaccaatttcgaagggacacgtccatacgaaccgtcttcctccctagtaaaacctcgtaaccctccgtcgaaccccggccgtacggaccgtaccggtacccggttttaatttacgtcggttcgggacgggttacggggaccgtaagggtaaccgttcgggttaccttttactaaaacgttccgttaaaggtcgggggtcccgtcggggtccctaaccccgttggggtcccttacgtcggtcccttccgttccacggtcccttacccgaacccgaacggggtccccacgttcccgggttcccctttcccccggg

SEQ ID NO: 388872 - DNA, 575 bp, Homo sapiens
  misc_feature: GZ8MTXP01BCSBR.44.23.C01.1.454.CMB.2.raw
  modified_base (271)..(271): a, c, t, g, unknown or other
  modified_base (306)..(306): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggttacaaacgaaaagggggngacggcccctaaggtcctcgtctctcgtgaaaccngactggaaggtacgacgtcccgtcaggttcagtcgccagtccgagggtggtgggccgagtccactctcaccaattagccgacctgccggcctgaagtacttctgtactaactttattctgtcagctagtatacatacgtcgtccccgtttcgtacgttttcggaccgtacggggtaccaaggtccgtagggtaaactacgaaacgtaacgtggtggctgccaccttatctgttcttcacttccctccgctatcttataacttaattaac

SEQ ID NO: 388873 - DNA, 580 bp, Homo sapiens
  misc_feature: GZ8MTXP01DQNGW.44.23.C01.1.454.CMB.2.raw
  modified_base (429)..(429): a, c, t, g, unknown or other
  modified_base (496)..(496): a, c, t, g, unknown or other
  modified_base (560)..(560): a, c, t, g, unknown or other
  modified_base (563)..(563): a, c, t, g, unknown or other
  modified_base (577)..(577): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggaatgggagtggattggtgacatccattatacgtggggcacgtactactctcccgtcctcaagcgtcgtctcacctatttcgagggacacgtccatcgaaccccgcttctccctagaaacctcgaaccctccggtcgacccgccgacggacctacggtccttttattctgtcgcgngcgagtactggttctttcaattcgtagtcggggccgtaggggcctaccgtggtcactcgtctcctcncgtccttaccaccgaagggcccctagttccggtccttccccgtgccgcccttgcctccgaggcnccncgttcgtcggggcncgg

SEQ ID NO: 388874 - DNA, 569 bp, Homo sapiens
  misc_feature: GZ8MTXP01C36G3.44.23.C01.1.454.CMB.2.raw
  modified_base (244)..(244): a, c, t, g, unknown or other
  modified_base (277)..(277): a, c, t, g, unknown or other
  modified_base (551)..(551): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggaggcagcgtcaccatcacttggccgggcgagtcaggttcgttttcggngctgttgccttggtttacaaacgaaaagggggnacggcccctaaggtcctcgtctctcgtagaaaccagactgggaaggtagacgtcccgtcaggttcagtgccagtccgagggtggtcggggccccgagtccatctcaacccattcgcgacctgccggcctagaaagcttctgactaacttattctgtcagctagtatcaggtagtccgtcccggttctacgtttggaccgtaggggaccaagctaaggaaactacaaacgactgtaaggcttgacacctatcttacgttcttcaacttcctcccnctacttctgttaacttaa

SEQ ID NO: 388875 - DNA, 615 bp, Homo sapiens
  misc_feature: GZ8MTXP01DZDAI.44.23.C01.1.454.CMB.2.raw
  modified_base (317)..(317): a, c, t, g, unknown or other
  modified_base (403)..(403): a, c, t, g, unknown or other
  modified_base (416)..(416): a, c, t, g, unknown or other
  modified_base (474)..(474): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcatttcgttggggctggactccggcacggcccccgaggggaggggaaatgggagtggtattggtgacatccattatacgtgggcacgtactactctccgtcctnaagacgtcgtctcactatttcgaggacacgtccatcgaacccgcttctccctagaacctcgaccctccgtcgacccgccgcggacncggtctttattcngtgcgagtcgagtacgttggttcttacatcgtagtggggcctggggctaccgtgtacnctgtcctctactgtccttaccgaccgaacgggccctaacgttccgggttccccttcccccgtcggtccccgttccccgttcgttcccgttccggaacggcggtacccctccggttccgggttcgggggccctaacccgggg

SEQ ID NO: 388876 - DNA, 615 bp, Homo sapiens
  misc_feature: GZ8MTXP01EMNLD.44.23.C01.1.454.CMB.2.raw
  modified_base (272)..(272): a, c, t, g, unknown or other
  modified_base (444)..(444): a, c, t, g, unknown or other
  modified_base (461)..(461): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgttttcggtgctgttgcctggttacaaacgaaaagggggngacggacccctaaggtcctcgtctcgtcgtacgaaaccagactagggaaggtagacgtcccgtaccgaggttcagtcgccaggtccgagggtggtcgggccccggagtccactctacaaacccattcggccgaacctcggccgggcctaggaaacgtattctgactaacttntttctgtcagtcagtanctatacgtcgtccccgttacttacgttttcggaccgtaggggacccaagccgtaaggaaactacgaaaacgtacgtggtgggcttggaccaccgtaattccgttacgttcttacctaacttcccttcccgcctagttcctaagttaatttaacg

SEQ ID NO: 388877 - DNA, 544 bp, Homo sapiens
  misc_feature: GZ8MTXP01BKV6Y.44.23.C01.1.454.CMB.2.raw
  modified_base (241)..(241): a, c, t, g, unknown or other
  modified_base (272)..(272): a, c, t, g, unknown or other
  modified_base (432)..(432): a, c, t, g, unknown or other
  modified_base (449)..(449): a, c, t, g, unknown or other
  modified_base (540)..(540): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttacaacgaaaagggggngacggcccctaaggtcctcgtctctcgtgaaaccagactggaaggtagacgtcccgtcaggttcagtgccagtccgaggtggtgggccccggagtccactctcaaccattgcgacctgcggctgaagtattctgctaacttattctgtacagctagtacncatagtcgtccccgttntacgtttggcctaggggaccagtcgtaggaaactcaaacgactgtcggcttgccacatcttgttcttcaattccttcccgctattctgttnttaa

SEQ ID NO: 388878 - DNA, 595 bp, Homo sapiens
  misc_feature: GZ8MTXP01CZXFT.44.23.C01.1.454.CMB.2.raw
  modified_base (315)..(315): a, c, t, g, unknown or other
  modified_base (414)..(414): a, c, t, g, unknown or other
  modified_base (471)..(471): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatgggagtggattggtgacatccattatacgtgggcgtacgtactactcctccgtcctcaagngtcgtctcacctatttcgaggacacgtccatcgaaccccgtcttctccctagaaactcgacctccgtcgaccgccgcgacacggtcttattctgtgcgnggcgagacgttggttcttacgaattctagtcggggtccgtggggctacccgtgtacncgtcgtctcctcacgtccttacccaccgaacgggccctacgttccggttcccttccccgtcggcccgttccccgttcgcccgtccgaacggtccgccgtaccgttcggtcgggggccaaccggg

SEQ ID NO: 388879 - DNA, 607 bp, Homo sapiens
  misc_feature: GZ8MTXP01DYGWK.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggaggggaatgggagtggattggtgacatccattatacgtgggcgacgtactactctccgtccctcaagacgtcgtctcacctatttcgagggacacgtcatcgaaccccgcttctccctagaaacctcgaccctccgtcgacccgccgcgacacggtccgtttatttctgtgcgaggcgagtacgtggttctttcaatctagtcggggccgtggggcctaccgtggtcctactcgtcctcctcacgtccttcccaccgaacgggccctacgttcccgggtccctttcccccgtcgggcccgttccccgttcgcccgtcccgacgggaacgcccgacccgttccggtcgggggccaacccggg

SEQ ID NO: 388880 - DNA, 913 bp, Homo sapiens
  misc_feature: GZ8MTXP01EGFEQ.44.23.C01.1.454.CMB.2.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcgaggttcgttttcggtgtcttggttcgtcccgttgggttttaccaaaacggtaaaaaagggggggacgaacgggaccccccttaaaggggtccccttcggttccttccgttacggtacgaaaaccccaggtaaccgtaggggaaacggtaggacggttcccccggttacctaggggtttccaagggttcgacccgtaaaggttccccgaagggggttcgggggttacgggggaccccccgggtaacggttcccaacgttcccttacccgaaaaccccgttaagttttaaccgggacccggtaaacccgttcggggaccccggggtaccctttaaggggaaaacgggttaactttccgtacggtaaccttaaaccgttttaacttttcccgttaggttaccgtaacgggtacctaaaggttaacttacccgtaaagttaacgggttacccggttccccccgggttttacgtttaacccggttttttacggggaccccggtaaacggggggtaaacccctaaagggtaccgttaaacggggtaaaacttaacccggaaaaaccggtaaaccgttgggtaacgggtcttacggacccttaaaccgtaacttccgttacggttcctttacccgtaactttccccggtttaaccccgaccctaacgttcccttaacggttaagtttaaaccg

SEQ ID NO: 388881 - DNA, 575 bp, Homo sapiens
  misc_feature: GZ8MTXP01CK4AE.44.23.C01.1.454.CMB.2.raw
  modified_base (474)..(474): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggattggtgacatccattatacgtggggcgacgtactactctccgtccctcaagagtccgtctcacctatttcgagggacacgtccatcgaaccccgcttctccctgaaactcgacctccgtcgaccgccgcgacacggtccgtttatttctgtgcgaggcgagacttggtcttcaatctagtggggccgtggggcacccgtggtccactgtcctccnctacgtccttccgaccgagggcccctagttccggttcccttccccgtcggtccgccccgttgccctccgacggcgccacccgttcgtcgggggccaaccgg

SEQ ID NO: 388882 - DNA, 551 bp, Homo sapiens
  misc_feature: GZ8MTXP01EHQP5.44.23.C01.1.454.CMB.2.raw
  modified_base (468)..(468): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatcccggcacgcccccgagggacgggaagtggagtggattggtgacatccattatactggggcgacgtactactctccgtccctcaacgagtcgtctcacctaattcgcgggacacgtccatcgaaccgcttctccctagaaactcgacctccgtgacccgccgcggaccacggtccgtttattctgtggcgaggcgagactggtcttnaatctagtgggccgtggctaccgttggtcacgtcgtcttccgttcacgtctccaacacgggcccacgtccgttccgttccccg

SEQ ID NO: 388883 - DNA, 587 bp, Homo sapiens
  misc_feature: GZ8MTXP01A5001.44.23.C01.1.454.CMB.2.raw
  modified_base (301)..(301): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttgggctggatccggcacgcccccgagggagggaagtggagtggattggnacatccattatacgtgggcacgtactactctccgtcctcaacgagtcgtctcacctaatttcggcggacacgtccatcgaaccgcttcctcctagaaactcgacctccgtcgacccgccgacggactacggtccgtttattcgtgtcgggcgtaggccgagtacgtcggttctttacgaagttcgtaaggttcggggtaccgtggcctacccgttggtcacgtcgtccttccgttcacgtccttaccgaaccgacgggccccttacgttccgttccctttccccgg

SEQ ID NO: 388884 - DNA, 585 bp, Homo sapiens
  misc_feature: GZ8MTXP01AGA0A.44.23.C01.1.454.CMB.2.raw
  modified_base (557)..(557): a, c, t, g, unknown or other
  modified_base (561)..(561): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatgggagtggattggtgacatccattatacgtggggcgacgtactactctccgtccctcaagagtcgtctcaccatttcgaggacacgtcatcgaaccccgcttctccctgaactcgacctccgtcgacccgccgcgacacggtcgtttattctgtgcgtaggcgagacgtggtctttcaattctagtcggggtccgtggggcctacccgtggtcctacttcgtcctccttcacgtccttaccaaccgtaacgggcccctagttcccggttcccttccccgtggcccgccccgttgccctccgnggcncctcccgttcgtcggggcaaccgg

SEQ ID NO: 388885 - DNA, 611 bp, Homo sapiens
  misc_feature: GZ8MTXP01D52VG.44.23.C01.1.454.CMB.2.raw
  modified_base (270)..(270): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatctattcgttggggctggatccggcacgccccgagggaggggagtggagtggagttggngacatccattagtacgtgggcgacgtactactcctccgtcctacaagtcgtcgtctcacctagtttacgagggacacgtcatcgaaccccgtcttctcctagaactcgacctccgtcgacccgccgacggacgtacggtcgtttattctaggtcgcggaggcgagtacgttggttctttacgaagttcgtaggtcggggccgtggggtccgtacccgttcggtcctacgttcgttcctccgtcacgtccttaccgaaccgtacggcctacgttccgttcccttccccgtggcccttcccgttcgccctcgagtccgctaccgttcggtcggggcaaccggg

SEQ ID NO: 388886 - DNA, 626 bp, Homo sapiens
  misc_feature: GZ8MTXP01B6O7R.44.23.C01.1.454.CMB.2.raw
tcagacagtatatacacgaccggtgctcgatttagtacacgtgattagggattgggggctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacgccccgagggagggaatggaggtggagttggtgactatcctattatacgtggggactacgtactactcctccgtcctacgaacgacgtcgtctaccacctaatttcgaacgggactaccgtccatcgaacccgtcttcctccctagaaacctcgaccctccgtacgacccgccggcgacgaccggttccgtttacttcgtcgtcggcgtacggcgacgtacgttcggttcctttactaaacgttcgtaggtcggggtacccgtggccctacccggttggttccacgttcgtcttacccgttcgacgtccttcccgaaccgacgggtcccttacgtccccgttccgttcccccgg

SEQ ID NO: 388887 - DNA, 565 bp, Homo sapiens
  misc_feature: GZ8MTXP01B5E30.44.23.C01.1.454.CMB.2.raw
  modified_base (396)..(396): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagccccagggagggaatggagtggattggtgacatccattatacgtggggcgacgtactactctccgtcctcaacgagtcgtctcacctaatttcgaagggacacgtccatcgaaccgcttccctcctanaactcgacctcgtcgaccgcgcgacgcgtcgtttattcgtgtcggcgaggcgagtacgtgttcttactaagttctaggtcgggtcgttggcctaccgttggtaccttcgtcgttccttccgttcacgtccttccaacgacgggccttacgtccggttccctttccccgg

SEQ ID NO: 388888 - DNA, 654 bp, Homo sapiens
  misc_feature: GZ8MTXP01ETK5J.44.23.C01.1.454.CMB.2.raw
  modified_base (219)..(219): a, c, t, g, unknown or other
  modified_base (224)..(224): a, c, t, g, unknown or other
  modified_base (236)..(236): a, c, t, g, unknown or other
  modified_base (268)..(268): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcacatcacttgccgggnagtcnggttcgtttggngctgtgccgtggttacaaacggaaaagggggnacggcccctaaggtccctcgtctcgtcgtagaaaccagacgtagggaaggtagacgtcccgtaccaggttcagtcgccaggtccgagggtgggtcgggccccggtactcgactctaccaaccctattcgccgaccgtcggccggcctaggaaacgtcttcgtgacctaactttattcctgttacagtactagttactactaacgtacgttccgtccccggtttagttaccggttttcgggacccggtacgggggaaccctaaggcgtaaaggtaaactacgtaaaaccgaacgtttgggcgtacttcggaccttaccgtaacttccgttcgttccttactaacctttcccttaaccccgctaacttccggtaagttaactttaacg

SEQ ID NO: 388889 - DNA, 568 bp, Homo sapiens
  misc_feature: GZ8MTXP01BB3GH.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatacgtggggcgacgtactactctccgtccctcaacgacgtcgtctcaccaatttcgaagggacacgtccatcgaaccgcttcctccctagaaactcgacctccgtgacccgccgcggaccacggtcctttattctgtggcgaggcgagactggtctttcaatctagtcggggccgttggcctaccgttgggtcacgtcggtccttccgttcacgtccttccaaccgtaacgggcccttactccgggttccttcccccgg

SEQ ID NO: 388890 - DNA, 622 bp, Homo sapiens
  misc_feature: GZ8MTXP01AF4D7.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgaggggaggggaatgggagtggattggtgactatccattatacgtggggcgacgtactactctccgtccctcaagacgtctctcacctatttcgaggacacgtccatcgaaccccgcttctccctgaaactcgacctccgtgacccgccggcgacgtacggtcctttattccgtgtgcggaggcgagacgtggttcttcaactcgtagtcggggtccgtacgggggcctacccgttggtcctaccgttcgtccgttacctccgtacgtccttacccgacccgaacgggtcccctacgttcccgggtccccttccccgtcggccccgttcccgcgttccctccgacggtcgaccctccgttcggtaacgggggccaaccgg

SEQ ID NO: 388891 - DNA, 622 bp, Homo sapiens
  misc_feature: GZ8MTXP01B3VCQ.44.23.C01.1.454.CMB.2.raw
  modified_base (400)..(400): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggatttccatcagttctgatctattcgtggggctggatccggcacgccccgagggagggaagtggagtggattggtgacatctattactacgtggggacgacgtactacttctccgtcctacaacgtacgtcgtctcacctaagtttcggaaggacacgtccatcgaaccgtcttcncctagaaactcgacctccgtcgacccgccgacggacctacggtctttacttcgtgtcggggcggtacggcgacgtacgtcggttctttacgaaacttcgtaacgggtcggggtcccgttggggccctacccggttcggtaccttcgttcggtcccttcccttcgacggtcccttacccgaaccgaaccgggtcccaacgttcccggttcccctttcccccgg

SEQ ID NO: 388892 - DNA, 569 bp, Homo sapiens
  misc_feature: GZ8MTXP01D0QSQ.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttgggctggatccggcacgccccgagggagggaagtggagtggagttggtgacatccattatacgtggggcgacgtactactctccgtcctcaacgagtcgtctcacctaattcgaagggacacgtccatcgaaccgtcttctccctagaaactcgacctccgtcgacccgccgacggacctacggtccgtttattcgtgtcgggacggtaggcgagtcgtggttctttacgaatcgtaggtcggggcctcggctaccgttggtcttacgtgtccttccttcacgtcctccaacgacggccagtccgttcttccccg

SEQ ID NO: 388893 - DNA, 607 bp, Homo sapiens
  misc_feature: GZ8MTXP01DSTKY.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgcccccgagggagggaagtggaggtggagttggtgacatccgtaattagtacgtggggcgtacgtactactctccgtcctacaacgagtcgtctcacctaattcgaacgggacacgtccatcgaaccgtcttcctcctagtaaactcgaaccctccgtcgaacccggtccgcggaccgtaccggtccgtttattcgtgttcggcggaggcgacgtactggttctttacaaacgttcgtagtcggggtccgttggcctacccgttcggtcttacgttcgtccttccgttcacgtccttcccaaccgtaacgggcccttacgtccgttcccgttccccg

SEQ ID NO: 388894 - DNA, 653 bp, Homo sapiens
  misc_feature: GZ8MTXP01BQ50V.44.23.C01.1.454.CMB.2.raw
  modified_base (245)..(245): a, c, t, g, unknown or other
  modified_base (276)..(276): a, c, t, g, unknown or other
tcagacagtatatacacgaccggtgctcgatttagtacacgtgattagggagttgggggaggtcagaccctgtcaggggacgagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaacgaaaaggggganacggacccctaaggtcctcgtctctcgtagaaaccagactgggaaggtagacgtccccgtcaggtttcagtgccgagtcccgaggtggtcgggccccggacggtccacgtcctacaaacccgtaattcggccgacccgttgggcccgggtaccttgaaaggtacttctagtacctaactttatttctgtacagtacagtatactattacgtccgtccccggtttctaacgtttttcgggaccgtaacgggggaacccaaggaccgttaaggggaaaacttaccgaaaacgtaccgttggtaagggtcccttggaccaccgtaattccttagttcctttacaacttcccgttcccgcctattcttaacgttaattaac

SEQ ID NO: 388895 - DNA, 606 bp, Homo sapiens
  misc_feature: GZ8MTXP01DVDQY.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcttggggctggatccggcacgcccccgagggagggaatggagtggattggtgacatcctattatacgtggggcgtacgtacgtactctccgtccctcaacgagtcgtctccactaatttcgaagggacacgtcatacgaaccgtcttcctccctagaactcgacctccgtcgaccgtccgcggactaccggtcctttattctaggtcgggtcggaggtcggacgtacgttggttcctttacgtaaacgttcgtaggtcggggtccgtacggcctaacccggttggtccttacgtcggttcttcccgttcacgtccttacccaacgaacgggcccagttcccgttcccgtttccccg

SEQ ID NO: 388896 - DNA, 653 bp, Homo sapiens
  misc_feature: GZ8MTXP01EB3DO.44.23.C01.1.454.CMB.2.raw
  modified_base (286)..(286): a, c, t, g, unknown or other
  modified_base (300)..(300): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgtggggctggatccggcacgccccgagggaggganggaggtggattggngacagtcctaattagtacgtggggccgtaacgtactacttcctcccgtccctacgtaacgacgtcgtctcacctaacgtttcgaacgggtacaccggtaccacgtacgaacccgtcttcctccctagtaaactcgacctcgtcgaccgtccgacgacgtaccggttccgtttattctggttcggggacggtacgggtacgtacgtacgttcggttacctttacgaaagttcgtaagggtcggggtcccgttcgggaaccctcccgttgggtccttacgttcggtccttccttcttaacggtcccttaccgaaccgtaacgggtcccacgttcccgggttccctttcccccggg

SEQ ID NO: 388897 - DNA, 573 bp, Homo sapiens
  misc_feature: GZ8MTXP01B84MO.44.23.C01.1.454.CMB.2.raw
  modified_base (433)..(433): a, c, t, g, unknown or other
  modified_base (515)..(515): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggatggagtggattggtgacatccattatacgtgggcgacgtactactctccgtccctcacgagtcgtctcacctaatttcgaagggacacgtccactcgaaccgtcttactccctagaaactcgacctccgtcgaccgccgcggaccncggtccgtttattctgtcggcgaggcgagtacctggttctttacaattcgtagtcgggggtcccgttggcctccgttggtcncgtcgtcttccgttcacgtccttccgaaccgacgggcccacgttccgttccttccccg

SEQ ID NO: 388898 - DNA, 604 bp, Homo sapiens
  misc_feature: GZ8MTXP01DP00C.44.23.C01.1.454.CMB.2.raw
  modified_base (500)..(500): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcagccccgagggagggaatggagtggagttggtgacatccattatacgtggggcgacgtactactctccgtccctcaagagtcgtctcactatttcgaggacacgtccatcgaaccccgcttctccctagaaacctcgaccctccgtcgacccgccggcggaccacggtccgttttattcgtgtgcggaggcgagtacgttggtctttacaatcgtaggtcggggccgtcggggcctaccgttggtcctacgtcgtcctccgtcncgtccttaccgacctaacgggccctacgttcccggtcccttccccgcggcccgttcccgttgccctccgacggaacgccgaccgttcggtcggggccaaccggg

SEQ ID NO: 388899 - DNA, 582 bp, Homo sapiens
  misc_feature: GZ8MTXP01COGWG.44.23.C01.1.454.CMB.2.raw
  modified_base (396)..(396): a, c, t, g, unknown or other
  modified_base (407)..(407): a, c, t, g, unknown or other
  modified_base (557)..(557): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggaatgggagtggagttggtgacatccattagtacgtgggacgtacgtactactctccgtccctacaagacgtcgtctcactagtttcgaggacacgtcatcgacccctcttctcctagaactcgacctcgtcgaccgcgcgacncgtcttattcngtgcgaggcgagtacttggtacttcatctagtcggggccgtcgggctaccgtggtcacgtcgtcctcctcacgtccttaccgacccgacgggccctacgttcccggtcccttccccgtcggcccttcccgcgccgtccgagggtaacccncgtccgttcgggtcgggaaccgcgg

SEQ ID NO: 388900 - DNA, 572 bp, Homo sapiens
  misc_feature: GZ8MTXP01BBSBL.44.23.C01.1.454.CMB.2.raw
  modified_base (445)..(445): a, c, t, g, unknown or other
  modified_base (461)..(461): a, c, t, g, unknown or other
  modified_base (466)..(466): a, c, t, g, unknown or other
  modified_base (472)..(472): a, c, t, g, unknown or other
  modified_base (507)..(507): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgattctattcgttggggctggatccggcacgcccccgagggacgggaatgggagtggagttggtgactatcattatacgtggggcgacgtactactcctccgtccctacaacgtcgtcgtcctcacctaatttcgaagggacacgtccagtcgaaccgtcttcctccctagaacctcgacctccgtcgaccgccgcgacncggtcttacttcgtgnggcgngcgagngtcgtctcatctagtcgggcgtgctccgttggtcncgtcgtccttccgttcacgtccttaccgaaccgaacggcccttacgtcccgttccgttcccccgg

SEQ ID NO: 388901 - DNA, 602 bp, Homo sapiens
  misc_feature: GZ8MTXP01BT8I1.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaacctgtctctcatctgcactgtctctggagtttccatcagttctgtatctattcgttggggctggatccggcacgccccgagggagggaagtggagtggtagttggtgacatccattatacgtgggacgacgtactactctccgtccctcaagatcgtctcactatttcgaggacacgtcatcgaaccccgtctctcctacgaaactcgaccctcgtcgacccgccgacggactacggtcgtttacttctgtgtcgaggcgagtacgttggtctttacaagtctaggtcgggtccgtcggggtctaccgttcggtcctctcgtcctcctcacgtccttaccaccgaacgggccctacgttcccggttcccttccccgtacggtcccgttcccgttcgccctccgacggaacgtccaccggttcgtcgggggcaaccgg

SEQ ID NO: 388902 - DNA, 811 bp, Homo sapiens
  misc_feature: GZ8MTXP01CCKQH.44.23.C01.1.454.CMB.2.raw
tcagacagtatatacacgaccggtgctcgatttagtacacgtgattagggattgggggctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgctactgtctcgtggtagtttccatctagttctgatctagttcgttgggctggactccggcacgccccgagggagggagtggagtggtagtggtagactatctattacgtacgtggggactacgtactactctccgtcctacaacgtcgtcgtctcactaacgtttcggaacgggactaaccgtccaacgtaccgaacccgtccttaccctcccgtaacgaaaccgttccgacccgttcccggtaccggaccccggaccgggaccgtaacccggtacccggtttcccgttttaacgtttccggtcgggttacggggaccggggtaacgggtaccggtaacgttaaccgtttacggtttaccctttttaacgtaaaaccgtttccggttaaacgggggttcccggggggttcccggttaccgggggtaaccccgttaacccccgggtttcggggtttaccccttaccggttttccggttcccctttacccccgttcgttaaccccgggttcccctttaaaccccgaaacccgggtaaacccgggggtcccccttaaccgggtttcccccggggtttccccccttttcccccccggggg

SEQ ID NO: 388903 - DNA, 631 bp, Homo sapiens
  misc_feature: GZ8MTXP01A0OS2.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatgggagtggattgggtgacatccattatactggggcgacgtactactctccgtcctcaagagtcgtctcaccatttcgagggacacgtccatgacgccgtcttctccctgaaaacctcgaaccctcgtcgacccggccgcggaccgacgggtccgttttactttcgtggttgcggacggcgagtacgttcggttctttacaattcgtagttcgggggccgttggcctaccgtggtcacgtgtcctcctctacgtccttacccgccgaacgggccccttagtcccggttcccttcccccgtcgggttcccgttccccgttcggccccttcccggaacggaaccggtcccgttaacccgtccggttcggggggtaaccccg

SEQ ID NO: 388904 - DNA, 624 bp, Homo sapiens
  misc_feature: GZ8MTXP01EC67C.44.23.C01.1.454.CMB.2.raw
tcagacagtatatacacgaccggtgctcgatttagtacacgtgattagggattgggggctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcagcccccgagggagggaatggagtggagtggtgacatccattagtacgtgggggcgacgtactactcctccgtcctcaacgactcgtctctacctaatttcgaagggtacacggtaccatacgaacccgtctttcctaccctcgaaactcgtaccctccgtacgacccggtccgacggactaccggtccgtttatttcgtgttcgggcggagggtccgtaggtaccgttggttcctttacgaaattcgtacgtcgggggtacccgtgggaaccctcccgttgggtccttacgtcgtccttccgttcacgtccttcccaaccgacgggcccttacgtccggttccttcccccgg

SEQ ID NO: 388905 - DNA, 623 bp, Homo sapiens
  misc_feature: GZ8MTXP01BYNDU.44.23.C01.1.454.CMB.2.raw
  modified_base (505)..(505): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggatggagtggagttggtgacatccattatacgtgggcgacgtactactctccgtcctcaagtagtccgtctctaccattttcgacggacacgtccatcgaaccccgtcttctcccgtagaactacgaccctccgtcgacccgcccgcggaccgacggtccgtttatttccgtgtggcgaggcgagtacgtggttcttcaattcgtagtcggggaccgtggggccgtacccgttggacgtactcgtcctcctcncttccgttccaaccgacgggtccctacgttccgggttcccttcccccgtcggtcccgttccccgttgcccgttcccgagggcccgtcctacccgttcggtaacgggggccaacccggg

SEQ ID NO: 388906 - DNA, 558 bp, Homo sapiens
  misc_feature: GZ8MTXP01D67XE.44.23.C01.1.454.CMB.2.raw
  modified_base (366)..(366): a, c, t, g, unknown or other
  modified_base (485)..(485): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggagggaatggagtggattggtgacatccattatacgtgggcgacgtactactctccgtccctcaacgagtcgtctcacctaatttcgngggacacgtccatcgaaccgcttcctccctagaaactcgacctccgtcgaccgccgcgacacgtccgttattctgtggcgaggcgagactggtctttcaatctagtggggccgtggccnccgttggtcacgtcgtccttccttcacgtccttcccgaaccgtaacgggcccagtcccggttccttcccccgg

SEQ ID NO: 388907 - DNA, 568 bp, Homo sapiens
  misc_feature: GZ8MTXP01BBL42.44.23.C01.1.454.CMB.2.raw
  modified_base (411)..(411): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggaatgggagtggagttggtgacatccattagtacgtgggcgacgtactactctccgtcctacaagacgtcgtctcactatttcgacggacacgtccatcgaaccccgcttctcctagaactcgacctcgtgaccgcgcgacacggtctttattctgtgcgngcgagtactgtcttcatcgtagtcgggccgtgggcctaccgtggtccacgtcgtctcctcgacgtccttccaccgacggccctacgttccgtcccttccccgtggcccgccccgttgccctccgacggaacgccgaccgttcgtcgggggcaaccgg

SEQ ID NO: 388908 - DNA, 582 bp, Homo sapiens
  misc_feature: GZ8MTXP01D7OQX.44.23.C01.1.454.CMB.2.raw
tcagacagtatatacacgaccggtgctcgatttagtacacgtgattggggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcttggggctggatccggcagcccccgagggagggaatggagtggattggtgacatccattatacgtggggcgtacgtactactctccgtcctcaacgagtcgtctcacctaatttcgaagggacacgtccatcgaaccgtcttctaccctgaaactcgacctccgtcgaccgccgcggacacggtccgtttattcgtcgttggcgagggcgagtacttggtctttcaaattctagtcgggccgttgggcctacccgttgggtccacgttcgtccttccttcttacgccttacccgaaccgaacgggcccacgttccggttcctttccccccg

SEQ ID NO: 388909 - DNA, 574 bp, Homo sapiens
  misc_feature: GZ8MTXP01CAEWQ.44.23.C01.1.454.CMB.2.raw
  modified_base (378)..(378): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggactccggcacggcccccgaggggacgggaagtggagtggagttggtgacatccattatacgtggggcacgtactactcctccgtcctcgaacgtacgtcgtctccacctaatttcgngggacacgtaccatacgaaccgtcttcctccctagaaactcgacctccgtcgacccgccgcgactacggtcctttattctgtcggcgaggcgagactggtcttcaatcgtagtcgggcgtggcctacccgttggtccacgtcgtcttaccgttcacgtctcccaacgtacgggcccttagtcccgttccttccccg

SEQ ID NO: 388910 - DNA, 598 bp, Homo sapiens
  misc_feature: GZ8MTXP01BYHPW.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggatgggagtggattggtgacagtccattatacgtggggcgacgtactactctccgtccctcaagagtcgtctcaccatttcgaggacacgtcatcgaacccgtttctcctgaaactcgaaccctccgtcgaccgccgcggacacgtcgtttattcgtgtgcgaggcgagacttggtctttcaattcgtagtcggggccgtcggcgtacccgttgggtccacgttcgtcctccgttcacgtcttcccgaaccgaacgggccctaagtcccggttccttcccccgttgggcccgtcccttgcccttccgaacggcgcccgtaccgtcggttacgggggaacccgcgggccgg

SEQ ID NO: 388911 - DNA, 573 bp, Homo sapiens
  misc_feature: GZ8MTXP01B5NTB.44.23.C01.1.454.CMB.2.raw
  modified_base (243)..(243): a, c, t, g, unknown or other
  modified_base (277)..(277): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggngtcttgttgcctggtttacaaacgaaaagggggnacggcccctaaggtcctcgtctctcgtgaaaccagactgggaagtagacgtcccgtcaggttcagtgccagtccgaggtggtcgggccccggagtccactctcaaccattcgcgacctggcgcctgaagattctgactaacttatttctgtaccagtcagtatctatagtcgtccccgttctacgttttcggaccgtaagggggaccaaggacgttagggaaactaccaaaacgtactggtcggcttcgcacctagtcttgttcttcaactccttcccgctattcctgaatttaac

SEQ ID NO: 388912 - DNA, 555 bp, Homo sapiens
  misc_feature: GZ8MTXP01CT40N.44.23.C01.1.454.CMB.2.raw
  modified_base (485)..(485): a, c, t, g, unknown or other
  modified_base (505)..(505): a, c, t, g, unknown or other
  modified_base (509)..(509): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggtatttccatcagttctgatcattcttggggctggatccggcacggcccccgagggaacgggaagtggaggtggagttggtgacatccattatactggggcgacgtactactctccgtcctcaacgacgtcgtctaccacctaagtttcgaagggacacgtaccactacgaacccgcttcctccctagaaacttcgacctccgtcgaccgtccgcggacgacgtccgtttattcctgtcggcgtagcgagactggtctttnaatctagtcgggcgtgcacngtcncgtgtcttcttcagctaccaacgacggccactccgttcgttccccg

SEQ ID NO: 388913 - DNA, 549 bp, Homo sapiens
  misc_feature: GZ8MTXP01BE05U.44.23.C01.1.454.CMB.2.raw
  modified_base (364)..(364): a, c, t, g, unknown or other
  modified_base (389)..(389): a, c, t, g, unknown or other
tcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccgagggagggaatggagtggattggtgacagtccattatacgtgggcgacgtactactctccgtcctcaacgagtcgtctcacctaatttcgngggacacgtccatcgaaccgcttcnccctgaaactgacctcgtgaccgccgcgacacggcgttattcgtgtggcgaggcgagactggtctttcaaattcctagtcggggccgtgggccacccgttggtcacgtgtcttccgttcacgtcttccaacgtaacgggcccagtccggttccttccccg

SEQ ID NO: 388914 - DNA, 656 bp, Homo sapiens
  misc_feature: GZ8MTXP01B3WMK.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgccccgaggggacgggagtggagtggtattggtgacatcctattagtacgtggggacgtacgtactactcctccgtcctacaacgtacgtcgtctccactaactttacgaaggaccacgtccacgtacgaaccgtcttcctcctagaacgtcgacctcgtcgacccgccgacggaccgtacggtccgtttatttcgtacggttgggacggtagggtccgaacgtacgttcggttctttacgtaacgttcttacgggtcgggggtcccgtcggtccgtaacccgttgggtccttaccgttcggtcccttcccttcgttaccgtcccttacccgaacccggtaaccgggccccttaacggttcccggttccccgtttccccccggg

SEQ ID NO: 388915 - DNA, 414 bp, Homo sapiens
  misc_feature: GZ8MTXP01EKJ0K.44.23.C01.1.454.CMB.2.raw
  modified_base (292)..(292): a, c, t, g, unknown or other
  modified_base (375)..(375): a, c, t, g, unknown or other
  modified_base (403)..(403): a, c, t, g, unknown or other
  modified_base (405)..(405): a, c, t, g, unknown or other
  modified_base (407)..(414): a, c, t, g, unknown or other
tcagacagtatatacacgaccggtgctcgatttagtacacgtgattagggattgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtgggccagggaccctggcaccgtctctcagcctccacaaggcccatcggtcctccccctggccnccctgctccaggacgccacctccgagacgccacgaggccggccctggggcctgcccccgtggtacaaggactacttcctaatntactgtctgagcgggctggcaaggcganangnnnnnnnn

SEQ ID NO: 388916 - DNA, 579 bp, Homo sapiens
  misc_feature: GZ8MTXP01EXHTC.44.23.C01.1.454.CMB.2.raw
  modified_base (220)..(220): a, c, t, g, unknown or other
  modified_base (238)..(238): a, c, t, g, unknown or other
  modified_base (270)..(270): a, c, t, g, unknown or other
  modified_base (305)..(305): a, c, t, g, unknown or other
  modified_base (412)..(412): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggnagtcaggttcgtttcggngctgttgccttggttacaaacgaaaagggggnacggcccctaaggtcctcgtctctcgtagaaaccngactggaaggtagacgtcccgtcaggttcagtcgccagtccgagggtggtcgggccggacgtccactctcacctaagttacgccgacctgccgggcctaggaacgtnttctagtactaactttattctgtcagctagtatacatacgtcgtcccttcgtacgttttcggaccgtacgggaccaagtcgtaggaaactacgaaacgtactggtcgctcgactaccttatctcgttcttcttacttccctcccgctactcttataattaacttaac

SEQ ID NO: 388917 - DNA, 619 bp, Homo sapiens
  misc_feature: GZ8MTXP01BUIGN.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttgggctggactccggcacgccccgaggggagggaatggagtggagttggtgactatcctattagtacgtggggaccgtacggtacctactcctccgtccctacaacgtacgtcgtctcacctaattcgcggacacgtccatcgaacgtcttcctcctagaaactcgacccgtccgtacgacccgccggacggtaccgaccggttccgtttacttcgtggtcgggcgtagggacgtacgtacgttcggttacctttacgtaaacgttcgtaggtcggggtccgtggcctacccgttggtccacgttcgtcttccgttcacgtccttaccgaaccgacggtcccttacgttccggttcccttccccgg

SEQ ID NO: 388918 - DNA, 601 bp, Homo sapiens
  misc_feature: GZ8MTXP01AGC99.44.23.C01.1.454.CMB.2.raw
  modified_base (302)..(302): a, c, t, g, unknown or other
  modified_base (373)..(373): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtatttccatctagttctgatctattcgttggggctggatccggcacgccccgagggagggatggagtggattggngacatccattagtacgtggggacgacgttactacttctccgtccctcaacgagtcgtctcacctattcggnggacacgtcatcgaaccgcttctccctagaaacctcgaccctcgtcgacccggccgacggacctacgggtcctttattcgtgtggacgtaggcgacgtacgttggtctttacgaagttcgtaggtcggggtccgtcggcctaccgttcggtaccttacgttcgtcttcccgttcgttactcctttcccgaacgtaaccgggcccttacgtccggttcccttcccccgg

SEQ ID NO: 388919 - DNA, 608 bp, Homo sapiens
  misc_feature: GZ8MTXP01B94QI.44.23.C01.1.454.CMB.2.raw
  modified_base (373)..(373): a, c, t, g, unknown or other
  modified_base (499)..(499): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacggccccgagggagggagtgggagtggatggtgacatccattactacgtggggcgtacgtactacctctcccgtccctacaagacgtcgtactcactatttcgaggacacgtccatcgaaccccgcttctccctanaactcgaccctcgcgacccgcgcgacacggtctttattctgtgcgagcgagtacgttggttacttcaattcgtaggtcggggtcccgtggggccgtacccgttcggtctacgttcgtcctcctacncgtccttaccaccgaacgggcccacgttcccgtcccgttccccgtcgcccgttccccgttcgcccgtccgaggtaaccgcccgtaccgttcggtccggggcaacccggg

SEQ ID NO: 388920 - DNA, 561 bp, Homo sapiens
  misc_feature: GZ8MTXP01BXPOE.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccgagggagggaatggaggtggattggtgacatccattatactggggcgacgtactactctccgtccctcaacgagtcgtctcacctaatttcgaagggacacgtccatcgaaccgcttcctccctgaaactcgacctccgtgacccgcgcggacacggtccgtttattcgtgtggcgagcgagactggtctttcaatctagtcggggtcgttcggcaccgttggtcacgttcgtcttccgttcagtcccttccaaccgtaacggcccttactccggttccttcccccgg

SEQ ID NO: 388921 - DNA, 715 bp, Homo sapiens
  misc_feature: GZ8MTXP01EA00O.44.23.C01.1.454.CMB.2.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttctgttcttcttctggttggagcagctcaccatcacgttggccgggcgtagtcgtaggttcgttttcggtgtcttggttcgtccgttaggttacaaaacggaaaagggggcacggacccgtaaggtcctcgtctcgtcgtacgaaaccaggacgtagggaaggtacgaccgttcccgtacgtaggttcacgtcgaccgtacggtccgaggggtcgggtcggggaccccgtacgtaccacgtcctaccgaaacccttaagttaaccggccgtacccgtcgggcccggtaccgtaggaaacgttactttcgtacgtaccttaaactttctttacgtacgttaccgagtacgtaagttactactaagtttacggtccccgtttaccccggggtttacgtttaacggttttccgggaccggtaaacgggggacctaaggtacgtaaacggtaaactaacgaaaacggtcgtgggtaacgtcgttacgacttacacttcgttcgttcttactcttccgtccctcacttctaagttaattaac

SEQ ID NO: 388922 - DNA, 674 bp, Homo sapiens
  misc_feature: GZ8MTXP01A6SVR.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggactccggcacggcccccgaggggagggaagtgggaggtggagttggtgactatcctattagtacgtggggcgtaccggtactacctcctcccgtccctacaagacgtcgtctctacctacgtttcggacgggtaccacgtaccagtacgaacccccgtccttctccctagtaacctcgtaccctccgtcgaacccgccggcgaccgtacggtccgtttacttcgtgtcggcgaggcgtagacgttcggttcttacgaacgttcgtaggttcggggccgttgggggacctacccgttgtacctcgtcgttcctccgtcgacgtccttacccgaaccgtaacgggtcccctaggttcccggttccccttccccgtcggggcccttccccgttgttcccctcggacggtaaccgcctacccggttcgggtaaccggggcctaaccggg

SEQ ID NO: 388923 - DNA, 619 bp, Homo sapiens
  misc_feature: GZ8MTXP01CFUEW.44.23.C01.1.454.CMB.2.raw
  modified_base (270)..(270): a, c, t, g, unknown or other
  modified_base (306)..(306): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcagtcaggttcgtttcggtgctgttgcctggtttacaacgaaaagggggnacggcccctaaggtcctcgtctcgtcgtagaaaccngactggaagtagacgtcccgtcaggttcagtcgccagtccgagggtggtcgggccccggagtccactcctacaaccattcgcgtacctgggccggtcctaggaaacgtacttctgtactaactttattctagtacagtctagtatactatacgttccgtaccccggtttctaccgttttcggacccgtaaggggtacccaaggtacgtacggtaaactaccgaaacgtaacgtggtaacggcttcggtaccaccgtaacttcgttcgttcttactaactttccctcccgacctagttccttgttaagtttaac

SEQ ID NO: 388924 - DNA, 880 bp, Homo sapiens
  misc_feature: GZ8MTXP01CM07K.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcaggtccagatgggtcctgtcccaggtgcagctgcaggagtcgggcccaggactggtgaggccttcgggaaccctgtctctcatctgctactgtctctggtacgtttccatcagttctgatctattcgttggggctggacgtccggtacgaccccgacgggaggggaaggtaggtaggtaggtaggttggtaggtacgtacgttaccgtaacgttaagttaacgttacgggggtaccgggtaaccgttaaccgtttaacccttacccgttccccgttacccccgttaccgtaaacggtaacggttacccccggttaccttaccgtaacccgtaaccgtttaccggtaaaccggggaaccgtaacccgtacccgtaacgttaaccggtaaccccgtacccgttacccttaccccgttacccggtaaaaccttaccgtaccccgttaccccgggtcggtaacccccggccccgggaccgggtaacccgtaacccgggttacccgggttttttaacttaccgttcggtacggggaccggtaggggggaacccggttaaggtaaccgtttcggggtttccttttacctaaacgtcggtttaaacggtcggggggtccccgtcggggtcccaaccccggtttcgggtaccttaccggtttcgttcccgttaccctcccgttaacgttccgttacccccgaacggtaaacccggggccctaacgttcccgggttccccttccccccggttcggtccccgg

SEQ ID NO: 388925 - DNA, 591 bp, Homo sapiens
  misc_feature: GZ8MTXP01EBYWL.44.23.C01.1.454.CMB.2.raw
  modified_base (353)..(353): a, c, t, g, unknown or other
  modified_base (444)..(444): a, c, t, g, unknown or other
tcagacagtatatacacgaccggtgctcgatttagtacacgtgattagggattgggggctttctgagagtcaaggacctcctgtgcaagaacatgaagcacctgttggtttttcctcctgctggtggcagctcccagatgggtcctgtcccaggtgcagctgcaggagtcgggcccaggctggtgaggccttcgggaaccctgtctctcatctgcactgtctctggtactttccatcagttctgatctattcgttggggctggatccggcacggccccgagggagggaagtggagtggattggtgacgatccattagtacgtgggcgtacgtactactctccgtcctcaacgngtcgtctaccacctaatttcgaacggactacgtaccagtacgaaccgtcttcctccctagaaactcgacctccgcgtacccgcgacggacncggttcctttattctgtcggcgaggcgagtactggttctttcaaacgttcgttaggtcgggtccgtggccctaccgttcggtcttacgttcgtccttcgttcacggttcctccaacgacggtcccagttcccgttccgtttccccgg

SEQ ID NO: 388926 - DNA, 665 bp, Homo sapiens
  misc_feature: GZ8MTXP01CE516.44.23.C01.1.454.CMB.2.raw
  modified_base (574)..(574): a, c, t, g, unknown or other
  modified_base (596)..(596): a, c, t, g, unknown or other
  modified_base (660)..(660): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagttccatctagttctgatctattcgttggggctggactccggcacgcccccgaggggaggggaagtgggagtggagttggtgacatcctattatacgtgggcgacgtactactctccgtccctacaagtcgtcgtctcactatttcggacggtacacgtccatacgtaacccccgtccttctacccgtacgaaacctaccgtacccgtccggtccggaccccggcccggaccgggaccgtaccgggtccgttttaactttcccgtaggtcggacggacgggacgtaacggtacgtttcgggttacctttacgtaaacgttcgttaacggtcgggggtccgtacgggggcctaccccggtggtcctacgtgtcctcgtacncgtcctaccaccgtacggcccngttcccgtccttccccgtcggccttccccgttgccctcgacgcgcctaccgttcggtcggggcnccggg

SEQ ID NO: 388927 - DNA, 616 bp, Homo sapiens
  misc_feature: GZ8MTXP01C06P9.44.23.C01.1.454.CMB.2.raw
  modified_base (354)..(354): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggatttccatcagttctgatcattcgttggggctggactccggcacgccccgagggagggaatggagtggagttggtgactatacctattatacgtggggacgtacgtactactctccgtcctacgaacgngtacgtctaccacctaattcggaaggtacacgtccagtcgaaccgtcttcctccctagaaactcgacctccgtagaccgccgacgacgtaccggtcgtttacttcgtgtcgggtcggacgggtcgtacgtacgttcggtctttacgaactcgttaggtcgggccgttggaacccgtaccgttcgggtccacgttcggtccttccgttcgacgtccttacccaaccgtacgggccccagtttcccgggttccctttcccccgg

SEQ ID NO: 388928 - DNA, 635 bp, Homo sapiens
  misc_feature: GZ8MTXP01CYCA7.44.23.C01.1.454.CMB.2.raw
  modified_base (268)..(268): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttgggctggatccggcacgccccgagggagggaagtgggagtggattggngacatcctattatacgtgggcgacgtactactctccgtccctacaagacgtcgtctcactagtttcgagggacacgtccatcgaacccccgcttcctcctacgaactcgaccctccgtcgacccgccgacggacctaccggtccgtttacttcgtgtcgcggtaggcgagtacgttggttctttacaacgtcgtaaggtcggggtccgtcggggacccgtaccgtcgtccgacgttcgtcctccgtactacgtccttacccgaccgaacggtcccgtaacgttcccggttcccttccccgtcggtcccttccccgttcgcccgttccgacggaactccgacccgttcggtcgggggcctaacccggg

SEQ ID NO: 388929 - DNA, 682 bp, Homo sapiens
  misc_feature: GZ8MTXP01A9E5W.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtactttccatctagttctgattctattcgttgggctggactccggcacgccccgagggaggaagtggaggtggtattggtgacatcctattagtacgtggggacgtacgtactactcctccgtccctacaacgtacgtcgtcctaccaccgtaactttcggaacgggtacctaccggtccaacgtaccgaacccgtccttacctacccgtagaaaaccttccgacccgttacccggtacggaaccccgtcccggaccggtacctacccggttaccgtttagtttccgtcggttcggggacggtacgggacgtacgtaccgttcggttacctttacgtaagttcgttaacggtcggggtcccgtggtcccgtacccgttggtccttacgttcgtcccttccgttcttacgtccttccgaaccgacgggtcccttacgtccggttcccttcccccgg

SEQ ID NO: 388930 - DNA, 659 bp, Homo sapiens
  misc_feature: GZ8MTXP01AE4OO.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgaggggaggggaatgggagtggagttggtagacatccattatacgtgggacgacgtactactccgtccgtcctacaagacgtcgtctacacctatttcggacggacacgtcactcgtaacccgtctctccctagaactcgaccctcgtcgaccgccgcgactacggtctttacgtcgtagtcggcgaggcgtagtacttggtctttacgaattcgtaaggtcgggggtacccgtcgggggtacctacccgttggtcctaacgttcgtccctccgtacacggtcccttaccgaaccgaaccggggtccccaacgttcccgggtccccttcccccggtcgggtccccttccccgttcgacccttccccggaacgggaaccgtcccggtacccgttcggggtcgggggcccgaaccggg

SEQ ID NO: 388931 - DNA, 656 bp, Homo sapiens
  misc_feature: GZ8MTXP01BVY6E.44.23.C01.1.454.CMB.2.raw
  modified_base (236)..(236): a, c, t, g, unknown or other
  modified_base (269)..(269): a, c, t, g, unknown or other
  modified_base (418)..(418): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgaccagtctccttcttctgtcttcttctgttggagcagcgtcaccatcacttggccgggcgagtcaggtcgtttcggngctggttgccttggttacaaacgaaaagggggnacggcccctaaggtcctcgtctctcgtacgaaaccagacgtaggaaggtagacgtcccgtacaggttcagtcgccgagtccagggtggtcggggccccggagtcacgtctacaaccattaacgcgtaacctggccgcctaggaaacgtnttctgtactaacttagtttctgtacagtcagtactctaagttacgtccgtccccggttctacgtttttcgggacccgtagggggtaacccaaacggtcgtaaacgggtaaattaaccgaaaacggtaccgttggtaacgggtaacttcgggacccttaaccgtacgttccttcgttcctttcccgtaacttccccgtttccccgtaccctaggttaccgttaagttaacttttaaacg

SEQ ID NO: 388932 - DNA, 570 bp, Homo sapiens
  misc_feature: GZ8MTXP01BIVMH.44.23.C01.1.454.CMB.2.raw
  modified_base (265)..(265): a, c, t, g, unknown or other
  modified_base (458)..(458): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgtgaaccctgtctctcatctgcactgtctctggagtttccatcagttctgatcattcttgggctggatccggcagccccagggaggggatggagtggattggtnacatccattatacgtggggcgacgtactactctccgtccctcaagagtcgtctcaccctatttccgagggtacacgtccatcgaaccgtcttcctccctgaaaacctcgaaccctccgtgacccgccgcggacacggtccgtttattctgtcgcgaggcgagacgtggtcttcatctagtcgggcggtggccncctggtcactgtctccttcacgtcttccaccgaacgggcccacgtccggttccgttcccccgtcggttccgcccttcgcctccgaacggacgccaccgtcgttcgggggccc

SEQ ID NO: 388933 - DNA, 669 bp, Homo sapiens
  misc_feature: GZ8MTXP01CF6N7.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgccccgaggggaggggaagtgggagtggagttggtgacatcctattatacgtgggacgtacgtactactctcccgtcctcaagcgtctctacactatttcgaggacacgtaccatcgaaccccgtcttcacctacgaaacctcgaccctccgtacgacccgccgaccgaccgtacgggtctttacttcgtgtcgcggaggcgtagtacgttcggttcttacgaacgttcgtaggtcgggggtaccgtcggggtcccgtacccggtcggttcctacgttcgtccgttcctacgtaccgtcccttacccgaccgaacccggggtcccctacggttcccggtttccccgttcccccgtcgggtccccttcccgttacgcccgttaaccggacggtaaccgccgtacccgttcgggtcgggggccaacccggg

SEQ ID NO: 388934 - DNA, 562 bp, Homo sapiens
  misc_feature: GZ8MTXP01BC5N9.44.23.C01.1.454.CMB.2.raw
  modified_base (268)..(268): a, c, t, g, unknown or other
  modified_base (311)..(311): a, c, t, g, unknown or other
  modified_base (475)..(475): a, c, t, g, unknown or other
  modified_base (477)..(477): a, c, t, g, unknown or other
  modified_base (517)..(517): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggngacatccattatacgtggggcgacgtactactctccgtccctnaagagtcgtctcaccatttcgaggacacgtccatcgaaccccgcttctcctgaaactcgaccctccgtgacccgccgacggacacggtcgtttactttcgtgttgcggaggcgagactggtctttcattctagtgggccgtggggcaccgtgtcactgtctccncngtccttccaccacggccattcggtccttccccgtggtccncccgttgcctccgaggcgccaccgttcgtcgggggttccaaccgg

SEQ ID NO: 388935 - DNA, 609 bp, Homo sapiens
  misc_feature: GZ8MTXP01EULLM.44.23.C01.1.454.CMB.2.raw
  modified_base (433)..(433): a, c, t, g, unknown or other
  modified_base (503)..(503): a, c, t, g, unknown or other
  modified_base (584)..(584): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgccccgaggggaggggaatgggagtggattggtgacatccattatacgtgggcgacgtactactctccgtcctcaagcgtcgtctcacctagtttacggacgggacacgtaccatcgaaccccgtcttctccctagaacctcgtacctccgtcgacccggcccgaccggtacgtaccggtccgttttattccgngtacggcggaggcgagtacgttggttacttacgattcgtaggtcggggccgtggggctaccgtggtaccncgtcgtcctctcagtcctaccgacgacggcctacgttccggttcccttcccgtcggccttccccgttgcccgtcgaggccnccgtacgttcggtcggggcaaccgg

SEQ ID NO: 388936 - DNA, 608 bp, Homo sapiens
  misc_feature: GZ8MTXP01DS0ZX.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggatccggcacgcccccgagggaacgggaatggagtggattggtgacatcctattatacgtggggcgcgtactactctccgtcctcaacgacgtcgtctcaccaatttcgaacgggactaccggtccaacgtcgaaccgtcgttacctccctagaaacctcgaacctccgtcgacccgccgcggacaccggtctttacgttcgtgtcgggtcgagggtccgagtacgtggttccttttacaaacttcgtaaggtcggggtccgttgggcctacccgttgggtccttacgttcgtccttaccgttcaacgtcttcgaaccaacgggcccttagtccggttcctttcccccg

SEQ ID NO: 388937 - DNA, 645 bp, Homo sapiens
  misc_feature: GZ8MTXP01DGZIJ.44.23.C01.1.454.CMB.2.raw
  modified_base (569)..(569): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggatttccatcagttctgatctattcgttgggctggactcggcacgccccgagggagggagtggaggtgagtggtgactatcctagttacgtacgtggggacgtacgtactacttctaccgtcctacaacgcgtcgtctcacctaattacggcggactacgtacatacgaaccgtcttcctccctagaaacctcgaccgtccgtcgacccgtccggacggacgtaccggttccgtttaactttcgtcggttcggggacggtaacggggtcgtacgtcggttcggtttccgtttacaaacgttcgtaacggtcgggggtcccgtggaacccgtaccgttggttaccncgtttcgtccttccgttcaacggtcccttaccgaaccgtaaccgggcccttacgttcccgggttcctttcccccgg

SEQ ID NO: 388938 - DNA, 588 bp, Homo sapiens
  misc_feature: GZ8MTXP01EE6VT.44.23.C01.1.454.CMB.2.raw
  modified_base (272)..(272): a, c, t, g, unknown or other
  modified_base (457)..(457): a, c, t, g, unknown or other
  modified_base (476)..(476): a, c, t, g, unknown or other
  modified_base (532)..(532): a, c, t, g, unknown or other
  modified_base (571)..(571): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttggccgggcagtcaggttcgttttcggtgctgttgcctggttacaaacgaaaagggggnaggcccctaaggtccctcgtctcgtcgtacgaaaccagactgggaagtagacgtccccgtacagggttcaggtcgccgagttccgagggtgggtcgggccccggagtccacgtctccaaaccattcggcgtaccgtggccgacctggaaagtacttctgtactaacttattctgtcagtcagtanctatacgtctcccgggttntacgtttcggaccgaggggaccaaggctaaggaaactacgaaaacgactggtcgcncgcacctactcttacgttcttctaacgtccttcccgctnttccgtaattaattaac

SEQ ID NO: 388939 - DNA, 575 bp, Homo sapiens
  misc_feature: GZ8MTXP01AOQIX.44.23.C01.1.454.CMB.2.raw
  modified_base (358)..(358): a, c, t, g, unknown or other
  modified_base (364)..(364): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatggagtggattggtgacatccattatacgtggggcgacgtactactcctccgtccctcaagacgtcgtctcaccatttcgaggacacgtcatcgaacccgcttcnccctanaaactcgacctcgtgacccgccgcggactacggtctttacttctgtcgcgaggcgagacgtggttctttcaattcgtagtcggggcctgggggcctaccgtggtcacgtgtcctcctcacgtccttccaccgaacgggcccctagttccggtccttccccgtggccgttcccgttgccctccgagcgccaccgttcggtcggggcaaccgg

SEQ ID NO: 388940 - DNA, 420 bp, Homo sapiens
  misc_feature: GZ8MTXP01D4CC2.44.23.C01.1.454.CMB.2.raw
  modified_base (418)..(420): a, c, t, g, unknown or other
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctgggggcccaggggaccgcggtcaccgtctcctcagcctccaccaagggcccatcggtcttccccctggcaccctcctccaagagcacctctgggggcacagcggccctgggctgccctggtcaaaggactctctatatactgtctgagcgggctggcaaggcgcatagnnn

SEQ ID NO: 388941 - DNA, 596 bp, Homo sapiens
  misc_feature: GZ8MTXP01A2UHT.44.23.C01.1.454.CMB.2.raw
  modified_base (242)..(242): a, c, t, g, unknown or other
  modified_base (276)..(276): a, c, t, g, unknown or other
  modified_base (554)..(554): a, c, t, g, unknown or other
  modified_base (578)..(578): a, c, t, g, unknown or other
  modified_base (580)..(580): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngtctgttgccgtggtttacaaacgaaaagggggngacggcccctaaggtcctcgtctctcgtagaaaccagactggaagtagacgtcccgtcaggttcagtcgccagtccgagggtggtcgggccccggagtccacgtctccgaaacctattaacggccgtaaccgtggcccgggtcctaggaaagtacttctagtactaacgtttattcctgtacagtctagtatcaatacgtcgtcccggttctacgtttcggaccgtaggggaccaggctaagggaaataccgaaacgactggtaagcttgaccacgtntcttgttcttctaactccgtcccncnttcctgttaattaacg

SEQ ID NO: 388942 - DNA, 738 bp, Homo sapiens
  misc_feature: GZ8MTXP01B3R8W.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacggcccccgagggacgggaatggagtggagtggtgacatccattatacgtggggcgacgtactactctccgtcctacaacgagtcgtctcacctaattcgaaggacacgtccagtcgaacccgtcttaccctaacccgtaaacgtccgtacccgttccggtaccgaccccggtacccggaccggtaacctacccggggttacccgtttaacgtttccgtacggttcgggaccgggggaacgggtccggtaacgtaccgtttcgggttccttttaacccgaaagttaccgttaacgggtccgggggtacccggttccgggtccccgtaaccccgttcggggttaaccctaccgttcggttccccttcccttccgggttaccttccccgttaaccccaaaccccgggttaaccgggaaccccctaccgggttccccggtttccccgttttcccccccggtccccgggg

SEQ ID NO: 388943 - DNA, 589 bp, Homo sapiens
  misc_feature: GZ8MTXP01BTGOE.44.23.C01.1.454.CMB.2.raw
  modified_base (373)..(373): a, c, t, g, unknown or other
  modified_base (526)..(526): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatcagttctgattctattcttggggctggatccggcagcccccgagggacgggaagtggagtggagttggtgacatccattatacgtggggacgacgtactactctccgtcctcaacgagtcgtctcactaattcgngggacacgtcatcgaccgtcttcctaccctagaaactcgacctccgtcgacccggccgcggaccgacggtcctttattcgtgttcgggcgtagggcgagacttggtctttacaaacttcgtaagtcggggtccgtgggcctaccgttggtacnccgttgtccttcgttcacgtccttccgaacgtacgggcccttacgtccggttcccttccccgg

SEQ ID NO: 388944 - DNA, 688 bp, Homo sapiens
  misc_feature: GZ8MTXP01BCQOJ.44.23.C01.1.454.CMB.2.raw
  modified_base (239)..(239): a, c, t, g, unknown or other
  modified_base (669)..(669): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccagtctccttccttctgtcttcttctgttggaggcagcgtcacatcacttgcggcgtagtcgaggttcgttttcggngtcttgttcgtccttaggttacaaacggaaaagggggcacggccccgtaaggtccctcgtctctcgtacgaaaccgagacgtaggaacggtacgacggttcccgtacgtaggttcgagtcgaccgtaggtccgaggggtcggggtcggggaccccgtacggtccacgttccgtaccaaaccgtaagttccggaccgtaacccgtcgggacccggtctagggtaaagttcttacgtacgtaacttaaactttacgtttactacggtactagaccgttaagtacttactaagttacgtccggttaccccgttgttacggtttcggaccggtaaacgggaccctaaggtactaaagggtaaactaaccgtaaacgtacgtggtaacgcgttacgcttaacgtctcttcgttcttacctaacttcccgttcccnctacgttctgttaattaac

SEQ ID NO: 388945 - DNA, 608 bp, Homo sapiens
  misc_feature: GZ8MTXP01C8NH6.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggatccggcacgcccccgaggggaggggaatgggagtggagttggtgacatccattatacgtgggcgacgtactactctccgtcctacaagcgtcgtctcacctatttcgaggacacgtccatcgaaccccgcttctccctagaaactcgaccctccgtcgacccgccgcgacacggtcgtttattctgtgcgaggcgagactggttcttacaattcgtagtcggggtccgtggggccctaccgtggtcctacgtcgtcctcctcacgtccttacccgaaccgaacgggcccctacgttcccggttcccttcccccgtcgggcccttccccgttcgcccgtcccgaaggcgcccgacccgttccggtcgggggccaacccggg

SEQ ID NO: 388946 - DNA, 593 bp, Homo sapiens
  misc_feature: GZ8MTXP01A386K.44.23.C01.1.454.CMB.2.raw
  modified_base (516)..(516): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggactccggcacgcccccgagggagggaatggagtggagttggtgacatcctattatacgtgggcgtacgtactactctccgtcctacaacgagtcgtctcacctaatttcgaaggacacgtccatcgaaccgtcttcctccctagaactcgtacctccgtgacccgccgcgacgacggtcctttattcgtgtcggcggaggtcgagtactggtctttacgtaatcctagtcgggtccgtggcctaccgttggtacncgttcgtccttccgttcgacgtccttcccgaaccgaaccggggtccccacggttcccggttcccgtttccccccggg

SEQ ID NO: 388947 - DNA, 576 bp, Homo sapiens
  misc_feature: GZ8MTXP01D5XF8.44.23.C01.1.454.CMB.2.raw
  modified_base (365)..(365): a, c, t, g, unknown or other
  modified_base (538)..(538): a, c, t, g, unknown or other
  modified_base (556)..(556): a, c, t, g, unknown or other
  modified_base (558)..(558): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctatttcgttggggctggactccggcacgccccgagggagggaatgggagtggattggtgacatcattatacgtgggacgacgtactactctccgtcctacaagacgtcgtctacacctagtttcgaggacacgtcatcgaaccccgcttcnccctagaaacctcgacctcgtcgacccgccgcgaccgtacggtcgtttattctgtcgcggaggcgagtacgtgttacttcgaattcgtagcgggtccgtcggggctaccgtggtcacgtcgtcctctcacgtcctaccgacaacggcctcgttccgttcccttcccgcgtccncccgttcgcctccgagcncnccgcgtcggggcaaccgg

SEQ ID NO: 388948 - DNA, 678 bp, Homo sapiens
  misc_feature: GZ8MTXP01AUEIC.44.23.C01.1.454.CMB.2.raw
  modified_base (361)..(361): a, c, t, g, unknown or other
  modified_base (383)..(383): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggactccggcacggcccccgagggacgggaagtggagtggtagttggtgactatcctattatacgtggggcgtacgtactactcctccgtcctcaacgngtcgtctccacctaactttcgnggactacgtcctactcgaaccgtcttcctccctacgaaactcgacccgtccgtacgaccccgccgccggaccgtaccgggtccgtttaacttcgttcggtcgggcggtaacggggtcgtaacggtaccgtttcgggttccttttacgaaacgttccgttaaagggttccgggggtcccggttcgggtcccgtaaccccggttgggtaccttcgttccggtcccttcccgttcgttaccgtcccttacccgaaccgtaacgggccccttacgttcccggttcccgtttcccccggg

SEQ ID NO: 388949 - DNA, 631 bp, Homo sapiens
  misc_feature: GZ8MTXP01ATM1T.44.23.C01.1.454.CMB.2.raw
  modified_base (426)..(426): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatctattcgttggggctggatccggcacgccccgaggggaggggaagtgggagtggagttggtgactataccattagtacgtggggacgacgtactactcctcccgtcctacaagcgtcgtctcacctagtttcggaggacacgtcactcgaaccccgtcttctcctacgaactcgacctcgcgaccgccgcgacacggtctttattctgtgacgnggcgagtactggttcttacaagttcgtaggtcggggtcctagggggccctacccgttggcctacgtcgtccctcctacgacgtcccttaccccgaaccggtccgggcccctacggttcccggtccccttcccccgtcggtccccgccccgttcggccccgtccgacggccgcccgtacccgttcgggaaccgggggccaaccggg

SEQ ID NO: 388950 - DNA, 771 bp, Homo sapiens
  misc_feature: GZ8MTXP01AYNB1.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgatctattcgttggggctggactccggcacgcccccgagggagggatggaggtggattgggtgactatccattagtacggtggggacgtacgtactactctcccgtccctcgaacgtcgtcgtcctacaccctaagtttcggaacgggacctaccggtaccagtacggtaaccgtctttacctaccctagaaaccttcgacccgttcccggtacgtaccccggcccggtaccggaacccgtaccgggttacccgttttacgtttccgtcggtcggggtcggtacggggtccgtaacggtaccgttcgggtttccttttaaccgaacgttccgttaacgggttccggggggtcccgttccggggaaccccgttaaccccgggttggggttaccccttaaccggttcgggttaccccttccccgttccgaaccggtttcccccgtttaccccggaaaccccgggtaaccccggggtcccccgttaaccggtttcccccggggtttcccccgttttccccccccggggg

SEQ ID NO: 388951 - DNA, 579 bp, Homo sapiens
  misc_feature: GZ8MTXP01EQ3UT.44.23.C01.1.454.CMB.2.raw
  modified_base (241)..(241): a, c, t, g, unknown or other
  modified_base (275)..(275): a, c, t, g, unknown or other
  modified_base (432)..(432): a, c, t, g, unknown or other
  modified_base (445)..(445): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcagtcgaggttcgttttcggngcttgttgccttggttacaaacggaaaagggggnacggcccctaaggtccctcgtctcgtcgtacgaaaccagacgtgggaaggtagacgtcccgactaggttcagtcgccagtccgagggtggcgggcccgacgtccacgtctacaacctatcgcgacctgccgctagagattctgactaacttatttcngttacagtcatancatacgtcgtacccggttctacggttttcggaccggaacgggtacccaaggtactagggaaactacgaaacgtacgtggtgcttcgccacgtactcttcgttcttctaactccttccgctattctgttaataag

SEQ ID NO: 388952 - DNA, 613 bp, Homo sapiens
  misc_feature: GZ8MTXP01BF7FG.44.23.C01.1.454.CMB.2.raw
  modified_base (275)..(275): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttgggtttacaaacgaaaaggggggngacggcccctaaggtcctcgtctctcgtgaaaccagactaggaaggtagagtcccgtcaggttcagtgcctagtccagggtggtgggccggacgtccactctcacccaattacgcgacctgcggcctgaagattctgctaacttattctgtcagcagtatctatagtcgtccccgttcgtacgttttcggccgtacggggtaaccaacggtccgtaggtaaaacctacgaaaaccgtaacgttcggtagggtccgttcggacctaccttacgttcttcggtttcctttcttactttcccttccccgtcctacgttcttacgtaatttaacgtttaacg

SEQ ID NO: 388953 - DNA, 630 bp, Homo sapiens
  misc_feature: GZ8MTXP01CUS2F.44.23.C01.1.454.CMB.2.raw
  modified_base (378)..(378): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgtggggctggatccggcacgccccgagggagggaatggagtggagttggtgactatccgtaattagtacgtggggaccgtacgtactactctcccgtcctacgaacgactcgtctcacctaatttcgnggtacacgttccatcgaaccgtcttccgtaccctagtaaaccgtcgtaccctccggtcgacccgtccggcggtaccgtaacgggttccgtttacgttcgtcggtggggacggtaggcgacgtacgtggttctttacgaagtcgtaggtcgggccgttggaaccctccgttggtcacgttcggtcttccgttcgttcgtccttacccgtaaccgtaccgggtcccttacgttcccgggttcccttcccccggg

SEQ ID NO: 388954 - DNA, 721 bp, Homo sapiens
  misc_feature: GZ8MTXP01CI6NU.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatctatttcgttggggctggactccggcacggcccccgaggggaggggaagtgggagtggtagttgggtgactatacctattagtacgtggggccgtaacgtacctactcctcccgtccctacaacggacgtccgtcctactacctacgtttaccggacgggtacctacgtccagtcgaaacccccgtccttacctccctagtaacctcgaaccctccggtcgacccggccgcggaccgtccggtccgtttactttcgtcggtcgcggtacggcgtagtacgttcggttccttactaacgttcgtacggtcggggtccggtcggggcccgtaccgttcggtacgtaccgttcggtcctccgtaccgtacgtccccttacccgacccggtaaccggccccgtaccgttccccgggttcccttcccccggtcccgggtccccgttccccgttcgttcccgtcccgaacggtccgtacccgtcccggttccggtccgggggcctaaccccgggg

SEQ ID NO: 388955 - DNA, 591 bp, Homo sapiens
  misc_feature: GZ8MTXP01E0SPN.44.23.C01.1.454.CMB.2.raw
  modified_base (341)..(341): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgtggggctggatccggcacgccccgagggagggaatggagtggattggtgacatccattatacgtgggcgacgtactactctccgtccctnaacgagtcgtctcacctaatttcgaagggacacgtccatcgaaccgtcttacctcctagaaactcgacctccgtcgacccgtccgcgacgtacggtcccgtttattctggttcggcggtagggcgacgtacgtggttctttacgaactcgtaggtcggggccgttggcctaccgttggtccttcgtcgtccttccgttcacgtccttcgaaccgaacgggtcccttacgttcccggttcctttcccccgg

SEQ ID NO: 388956 - DNA, 589 bp, Homo sapiens
  misc_feature: GZ8MTXP01EPSJZ.44.23.C01.1.454.CMB.2.raw
  modified_base (425)..(425): a, c, t, g, unknown or other
  modified_base (497)..(497): a, c, t, g, unknown or other
  modified_base (546)..(546): a, c, t, g, unknown or other
  modified_base (569)..(569): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgaggggagggaatgggagtggattggtgacatccattatacgtggggcgacgtactactcctccgtccctcaagagtcgtctcacctatttcgaggacacgtccatcgaaccccgtcttctccctgaaacctcgaccctccgtcgacccgccgcggactacgggtctttattctgtgcggnggcgagtacgtcggttctttcaattcgtagtcggggccgtcggggcctaccgtcggtcacgtcgtccttccnctcgtccttccaccgaacggccctcgttccggtccttccccgcggtccncccgttcgcctccgacggcgtcnccgttcgtcggggcaaccgg

SEQ ID NO: 388957 - DNA, 672 bp, Homo sapiens
  misc_feature: GZ8MTXP01CTQ0S.44.23.C01.1.454.CMB.2.raw
  modified_base (220)..(220): a, c, t, g, unknown or other
  modified_base (271)..(271): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggtcgttttcggtgctgttgcctggtttacaacgaaaaggggggngacggcccctaaggtcctcgtctctcgtagaaacccagacgtggaaggtagacgtcccgtcaggttcagtcgccagtccgaggtggtcggggccggacgttccacgtctaccaccctaaagttacggccgaaccgttggccgggccctagaaaggtactttcctagtacctaaacttttattttcgtggttaccaaggtctaaggttactacaagttacgtccgtcccccgtttagtacccgtttttggggccccgtaagggggacccctaaaggtccgttaagggaaaacttaccgaaaaccgtaactcgggtaggtctacggacctaaccacgtttacgtgttccctttcgaacctttcccttacccccgctaacttccttagtaacttaactttaacg

SEQ ID NO: 388958 - DNA, 624 bp, Homo sapiens
  misc_feature: GZ8MTXP01AFQSG.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcagccccgagggaggggaatgggagtggattggtgacatccattagtacgtgggcgacgtactactctccgtccctcaagacgtcgtctcacctatttcgagggacctacgtccatcgaaccccgtctctccctagaaactcgaccctccgtcgacccgtccgaccggactacgggtccgttttattctgtcgcggaggcgagtacgttggttctttacaattcgtaggtcggggtccgtcgggggcctacccgttgtccgtacgtcgttcctcctcgacgtcccttaccaaccgacgggcccctacggttccgttcccttcccccgtcggcccttccccgttcgccctccgacggccgccgtacccgttcggtcgggggccaaccggg

SEQ ID NO: 388959 - DNA, 706 bp, Homo sapiens
  misc_feature: GZ8MTXP01ATDT4.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcatttcttggggctggatccggcacgccccgagggaggggaatgggagtggagttggtgactagtcctaagttagtacgtgggggacgtacggtacctactccttcccgtcccctacaagacgtccgtctccacctatttcggacggacacgtccatcgaaccccgtcttctccctagaaacctcgaccctccgtcgacccgccgcgacgtacggtccgtttattctgtcgcgaggcgagtactggttctttcaagttcgtagtcgggggtccgtcggggacctcccgttgggtacctaccgttcgtcccttccctcgaccgtcccgtttaacccgacccggtaaaccggggtcccctaacgttccccggggttcccctttcccccccggtcggggtccccgttcccccgtttcggaacccccgttcccgggaacgggggtaaccccgtcccggttaccccgggttccggggtccgggggcccgtaacccggg

SEQ ID NO: 388960 - DNA, 633 bp, Homo sapiens
  misc_feature: GZ8MTXP01DL1E3.44.23.C01.1.454.CMB.2.raw
  modified_base (495)..(495): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgaggggagggaatggagtggattggtgacagtccattatacgtgggcgacgtactactctccgtcctcaagagtcgtctcacctatttcgaggacacgtccatcgaaccccgcttctccctagaaacctcgaccctccgtcgacccgccgcgacacggtccgtttattcgtgtcgcgaggcgagtacgttgttcttcaattcgtagtcggggccgtcggggcctacccgtggtcacgttcgtccttcctacncgtccttacccgaaccgaaccggggcccctaacgttcccggttccctttcccccgtcgggccccgttccccgttcgccccttcccggaccggtaacccgtacccgtccggttcgggggcccttaaccggaacccgggg

SEQ ID NO: 388961 - DNA, 604 bp, Homo sapiens
  misc_feature: GZ8MTXP01BME4Z.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggaatggagtggattggtgacatccattatacgtgggcgacgtactactctccgtccctcaagacgtcgtctcacctatttcgagggacacgtccatcgaaccccgcttctccctagaaactcgacctccgtcgacccgccgcggaccacggtccgtttattctgtgcgaggcgagtacgtggttcttcaatcgtagtcggggtccgtcggggctacccgtggtccactcgtcctccgtcacgtccttacccgaccgtaacggggcccctaacgttcccggttcccttcccccgtcggtcccgttccccgttcgcccttccgacggtcgccgaccgttcggtcgggggcaacccggg

SEQ ID NO: 388962 - DNA, 582 bp, Homo sapiens
  misc_feature: GZ8MTXP01C3EKR.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggagttggtgacatccattatacgtgggggcgacgtactactctccgtccctcaacgtcgtcgtctcacctaactttcgaagggacacgtccatcgaaccgtcttcctccctagaaacctcgacctccgtcgaccgccgacggaccacggtccgtttattcgtgtgggcgaggcgagtactggtctttcgaatcgtagtcggggccgtggcctacccgttggtcacgtgtcttccgttcacgtccttaccgaaccgtaacgggcccagtcccggttcctttcccccgg

SEQ ID NO: 388963 - DNA, 548 bp, Homo sapiens
  misc_feature: GZ8MTXP01CR83G.44.23.C01.1.454.CMB.2.raw
  modified_base (240)..(240): a, c, t, g, unknown or other
  modified_base (271)..(271): a, c, t, g, unknown or other
  modified_base (498)..(498): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggttcaaacgaaaaagggggnaggcccctaaaggtcctcgtctctcgtgaaaccagactggaagtagagtcccgtcaggttcagtgccagtccaggtggtggcccggagtcatctcaaccattaagcgacctgcggcctgaaacgatctgcaacttatttctgtcagcagtatcatagtcgccccggttcaaccttttggacccagggggaccaaagcttagggaaatacaaacgaaactagtggcgncacactcttcgttcttctaactccttcccgtcctacttactgttaagtaa

SEQ ID NO: 388964 - DNA, 554 bp, Homo sapiens
  misc_feature: GZ8MTXP01CCBMA.44.23.C01.1.454.CMB.2.raw
  modified_base (348)..(348): a, c, t, g, unknown or other
  modified_base (368)..(368): a, c, t, g, unknown or other
  modified_base (399)..(399): a, c, t, g, unknown or other
  modified_base (470)..(470): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcttggggctggatccggcacgccccgagggagggatggagtggattggtgacatccattatacgtggggcgtacgtactactcctccgtcctcaacgngtcgtctcacctaatttcgnggactacgtccatcgaaccgcttctaccctnaaactgacctccgtgacccgccgcgacgcggtccgtttacttcgtgtcggcgaggcgagtactggtctttnaactctagtcggggccgtggccaccgttggtcacgtgtcttccgttcacgtcttccaacgacggcccatccggttccttccccg

SEQ ID NO: 388965 - DNA, 600 bp, Homo sapiens
  misc_feature: GZ8MTXP01DC0D9.44.23.C01.1.454.CMB.2.raw
  modified_base (276)..(276): a, c, t, g, unknown or other
  modified_base (426)..(426): a, c, t, g, unknown or other
  modified_base (483)..(483): a, c, t, g, unknown or other
  modified_base (573)..(573): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctatttcgttggggctggatccggcacgccccgagggagggaagtggagtggatggtgacancattatacgtgggacgtacttacgtactcctccgtccctcgaacgtacgtccgtctaccacctagtttcgagggactacgtccatcgaaccccgtcttctccctagaaactcgacctccgtcgaccgccgcgacctcggtctttatctgngacgagcgagacgttgttcttacatcgtaggtcgggcgtcggggcctaccgtgtacnctcgtcctctcgactcctacccgaccgacggccctacgttcccggttcccttccccgtggtcccttcccgttcgcccgtccgacggtccnccgaccgttcggtcggggccaaccggg

SEQ ID NO: 388966 - DNA, 606 bp, Homo sapiens
  misc_feature: GZ8MTXP01D8G46.44.23.C01.1.454.CMB.2.raw
  modified_base (565)..(565): a, c, t, g, unknown or other
tcagacagtatatacacgaccggtgctcgatttagtacacgtgattagggattgggggctttctgagagtcaaggacctcctgtgcaagaacatgaagcacctgttggtttttcctcctgctggtggcagctcccagatgggtcctgtcccaggtgcagctgcaggagtcgggcccaggactggtgacggccttcgggaccctgtctctcatctgcactgtctctgtatttccatcagttctgatctattcgtggggctggactccggcacgccccgagggagggatggagtggagtggcgacatcctaagttatacggtgggggaccgtaacgtacctacgttcctcccgtccctactaacgacgtcgtctaccaccgtaacgtttcggaacgggacctaccgtaccactacgaaccgtcttaccctacctagaactcgacctcgcgtacccgcgacgacgtacgttcttattcgtgtacggcggtaggtcgtagtacgttcgtctttactaattcgtacggtcgggtccgtcgaactcgttcgtcttcgtcgtccttcgttcncgtcctaccgaacgaccgtccttacgtccgttcccgtcccg

SEQ ID NO: 388967 - DNA, 614 bp, Homo sapiens
  misc_feature: GZ8MTXP01CONP0.44.23.C01.1.454.CMB.2.raw
  modified_base (220)..(220): a, c, t, g, unknown or other
  modified_base (239)..(239): a, c, t, g, unknown or other
  modified_base (271)..(271): a, c, t, g, unknown or other
  modified_base (379)..(379): a, c, t, g, unknown or other
  modified_base (410)..(410): a, c, t, g, unknown or other
  modified_base (591)..(591): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcacatcacttgccgggngagtcaggttcgtttcggngctgttgccttggttacaaacgaaaagggggnacggcccctaaggtccctcgtctctcgtagaaaccagactgggaaggtagacgtccccgtcaggttcagtcgccaggtccagggtggtcgggccccggagtccactcncaaccattcgcgacctgcggcctagaaagtnttctgctaacttatttctgtacagcagtactctagttacgtccgtccccggtttctaccgttttcgggacccgtacgggggacccaaaggtcgtaacgggaaactaccgaaaacgtaacgtggtaacggcttcggaccaccgtacttccttacggttccttacctaacttcccgttccccnctacttccttaagttaatttaac

SEQ ID NO: 388968 - DNA, 599 bp, Homo sapiens
  misc_feature: GZ8MTXP01AR51K.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcacgccccgaggggaggggaatgggagtggattgggtgacatccaattagtacgtggggcgacgtactactctccgtccctcaagagtcgtctccacctatttcggacgggacaccggtccatcgaaccccgcttctccctagaaactcgacctccgtcgaccgccgcgacacggtcgtttattcgtgtgcgaggcgagtactggttcttcaattcgtagtggggccgtggggcctaccgtggtcacgttgtcctcctcgacgtcccttaccaccgacgggtccccacgttccggtcccttcccccgtggcccgcccgttcgccctcgaggaacgccaccggttccggtcgggggccaaccggg

SEQ ID NO: 388969 - DNA, 610 bp, Homo sapiens
  misc_feature: GZ8MTXP01EEC6G.44.23.C01.1.454.CMB.2.raw
  modified_base (406)..(406): a, c, t, g, unknown or other
  modified_base (419)..(419): a, c, t, g, unknown or other
  modified_base (443)..(443): a, c, t, g, unknown or other
tcagacagtatatacacgaccggtgctcgatttagtacacgtgattagggattgggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacggccccgaggggaggggaatgggagtggattggtgacatccaattatacgtcggggactacgtactactctccgtcctacaagtcgtcgtctcactacgtttcggagggtacacgtcagtcgaaccccgtcttctcctagaactcgacctcgtgacccgcgcgacncggtcgttattcngtcgcgagcgagtactggttcttnattcgtagtcgggccgttcggggctaccgttggtcctacgtcgtccttcctcgtacgtccttccaaccgtaacggggtcccctacgttcccggtccctttccccgtcgggtcccttccccgttgcccgtccgacggcgccgaccgttcggtaacgggggccaaccgg

SEQ ID NO: 388970 - DNA, 672 bp, Homo sapiens
  misc_feature: GZ8MTXP01ET74T.44.23.C01.1.454.CMB.2.raw
  modified_base (274)..(274): a, c, t, g, unknown or other
  modified_base (377)..(377): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcaggttcgttttcggtgcttgttcgcttggtttacaaagaaaagggggnacggcccctaaggtcctcgtctctcgtagaaaccagactgggaaggtagacgtcccgtcgaggtcagtgccagtccgaggtggtgggccccggagtcacgtcncaaccattcgcgaccgtgccggcctaggaagtattctagtacctaacgtttatttctgtactagctaagtactcaagttagttccgccccggtttcttaccggttttgggacccgtaagggggtaacccaagggtaccgttaagggaaaacttaccggaaaaacggttaccttggggtaacgggtccttacgggaccttaaccccgtaatttccgtttaacggtttcctttacccaaccgttttccccttaacccccggtccctaatttaccgttaaggtttaaaccttttaacg

SEQ ID NO: 388971 - DNA, 608 bp, Homo sapiens
  misc_feature: GZ8MTXP01DZ9X5.44.23.C01.1.454.CMB.2.raw
  modified_base (557)..(557): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacggcccccgagggacgggaatggagtggattggtgacatccattatacgtgggctacgtactactctccgtcctcaacgacgtcgtctcaccctaagtttcgaagggacacgtccctatacgaacccgtcttctccctagaaactcgaccctccgtacgacccgtccgacggacaccggtccgtttaattcgtagttcgggcgagggtccgaggtacttggtcctttacgaattcgtaggtcgggccgttcggcctacccgttggtacacgttcgtccttccgttcncgtcccttaccgaacccgtaacgggcccagttcccgttcccgttcccccgg

SEQ ID NO: 388972 - DNA, 596 bp, Homo sapiens
  misc_feature: GZ8MTXP01EH2AR.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacgccccgagggagggatggagtggatggtgacatccattatacgtgggggactacgtactacttcctccgtccctacaacgtacgtcgtctcacctaatttcgaagggactacgtccatacgaacgtcttactccctagaactcgacctcgtacgacccgcgacgacgacgtcgtttattctgtgggcgaggcgtagtacgttggtctttcaaacgttcgtacggtcggggtccgtgggcctacccggttggtccttacgtcgtccttaccgttcacgtccttccgaaccgtaacgggcccttacgttcccgggttcccttccccgg

SEQ ID NO: 388973 - DNA, 604 bp, Homo sapiens
  misc_feature: GZ8MTXP01BEQ3F.44.23.C01.1.454.CMB.2.raw
  modified_base (241)..(241): a, c, t, g, unknown or other
  modified_base (275)..(275): a, c, t, g, unknown or other
  modified_base (475)..(475): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcagggttcgttttggngcttgttgcctggtttcaaacgaaaaaggggggngacggcccctaaagggtccctcgtctctcgtgaaaccagactgggaaggtagagtccccgtcaggttcagtgccagtccgagggtggtgggccccggagtccactctcaaccctattaacgccgaaccctggccgggcctaggaaacgtattctgactaactttatttctgtcagctagtatcagtagtcgccccgtttnacgttttcggaccgagggggtaccaagcgtagggaaactacgaaacgtaacgtgtaacgggcttaggccaccgtaatccttgttccctttaccaattcccgtttccccgcctattccttcgaatttaac

SEQ ID NO: 388974 - DNA, 592 bp, Homo sapiens
  misc_feature: GZ8MTXP01C62CZ.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttggggctggatccggcacgccccgaggggagggaagtgggagtggagttggtgacatccattatacgtgggacgacgtactactctcccgtcctacaagtacgtcgtctcacctatttcgacgggacacgtcatcgaaccccgtcttctcctagaactcgacctccgtcgacccgccgacggacacggtctttattctgtgcgaggcgagactggttcttcatcgtagtcgggtccgtggggccaccgttggtctacgtcgtctcctcacgtccttaccaccgacggccctacgttccggttcccttccccgtcggcccgttcccgttcgcctccgacggaacgccgaccgttcggtaacgggggccaaccggg

SEQ ID NO: 388975 - DNA, 584 bp, Homo sapiens
  misc_feature: GZ8MTXP01BIKHX.44.23.C01.1.454.CMB.2.raw
  modified_base (264)..(264): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggaatggagtggattggngacatccattagtacgtggggcgacgtactactctccgtcctcagacgtcgtctcacatttcgaggacacgtcatcgaacccgcttctccctagaaacctcgaccctccgtgaccgccgcgacacggtctttattctgtgcgaggcgagtacgttggttcttcaattctagtggggtccgtggggctaccgtggtctacgtcgtcctcctcgacgtccttccaccgaacgggccctacgttcccgggtcccttccccgtcggcccgttcccgttggccctccgacggaacgtccgaccgttccggtcgggggccaaccgg

SEQ ID NO: 388976 - DNA, 597 bp, Homo sapiens
  misc_feature: GZ8MTXP01C2BZO.44.23.C01.1.454.CMB.2.raw
  modified_base (494)..(494): a, c, t, g, unknown or other
  modified_base (542)..(542): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggactccggcacgcccccgaggggagggaatggagtggagttggtgacatcatatacgtgggcgtacgtactactcctccgtcctcaagcgtcgtctcacctatttcgacggacacgtaccatcgaaccccgcttctcctagaaactcgacctccgtcgacccgccgcggaccacggtcgtttacttcgtgtcgcgaggcgagactggtcttcaattcgtagtggggcctggggccaccgttgtccactcgtcctctcacgtccttaccnccgaacgggcccctacgttcccgggttcccttcccccgtcggggcccnccccgttgccctcccgaaggtccgccgacccgttcgggtccggggccaacccggg

SEQ ID NO: 388977 - DNA, 684 bp, Homo sapiens
  misc_feature: GZ8MTXP01C1U1E.44.23.C01.1.454.CMB.2.raw
  modified_base (305)..(305): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacgcccccgagggacgggaagtggagtggagttggngacatccattatacgtgggcgtacgtactactctccgtcctcaacgtagtcgtctcacctaagtttcgaaggacacgtccatcgaaccgtctcctccttagaaactcgacctccgtcgaacccgccgcgaccgtacggtccgtttaattccgtggttcggcggtaacggccgtaaggtaccgttgggttcctttacgtaaacgttccgttaaacgggttcgggggtcccggtttgggccccgttaacccggttcggggttacccaaccgtttcgggttccctttacccgttccttaaaccgggttcccctttaccccgaacccgtaaaccggggtccccttaacggtttccccggggttccccttttaacccccccggg

SEQ ID NO: 388978 - DNA, 605 bp, Homo sapiens
  misc_feature: GZ8MTXP01BX6WM.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggactccggcacggccccgagggacgggaagtggaggtggattggtgacatcattatacgtgggcgtacgtactactcctccgtcctcaacgacgtcgtctccacctaagtttcgaagggactaccgtaccatacgaaccgtcttacctccctagaaactcgacctccgtacgacccgcgcgacgacgtccgtttattcgtagtcggcgaggcgacgtcgttggttctttagaacttcgtaaggtcggggtcctcgggcctacccgttgggtccacgttcgtccttccgttcacgtccttacccgaaccgtaacgggccccttacgttcccgttccgttcccccgg

SEQ ID NO: 388979 - DNA, 604 bp, Homo sapiens
  misc_feature: GZ8MTXP01CFIYA.44.23.C01.1.454.CMB.2.raw
  modified_base (244)..(244): a, c, t, g, unknown or other
  modified_base (276)..(276): a, c, t, g, unknown or other
  modified_base (311)..(311): a, c, t, g, unknown or other
  modified_base (383)..(383): a, c, t, g, unknown or other
  modified_base (413)..(413): a, c, t, g, unknown or other
  modified_base (468)..(468): a, c, t, g, unknown or other
tcagacagtatatacacgaccggtgctcgatttagtacacgtgattagggattggggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggngtctgttgcctggttacaaacgaaaagggggnacggcccctaaggtcctcgtctctcgtagaaaccngactgggaaggtagacgtcccgtcaggttcagtcgccagtccgagggtggtcggggccccggagtccactcncaacctatgcgacctgcgcctgaagcttcngactaactttattctgtacagtctagtactctaatacgttccgtaccccggtttnttaaccggttttcgggacccgtaagggggaccctaaaggccgttaaggaaactacgaaaacgtacgtggtcggacttcgaccacccgtatcttcgttccttcaaccttccttccccgctattcctaagaactttaa

SEQ ID NO: 388980 - DNA, 622 bp, Homo sapiens
  misc_feature: GZ8MTXP01C3ULY.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacgccccgaggggagggaagtgggagtggagttggtagacatccaattagtacgtggggacgacgtactactctcccgtccctcaagacgtcgtctcacctagtttcgagggactacgtaccatacgaacccccgtcttactcccgtagaaacctcgtaccctccggtcgaacccgtccgacggaccgacggtcgtttacttcgtgtcgcggagcgagacgtggttcttacagtcgtaagtcggggccgtggggcctaccgttggtcctacgttcgtcctccgtcacgtcccttacccgacgaacgggtccccagttcccgtcccttccccgtggcccgcccgttcgccgtccgacggctccgtaccgttcggtcggggcaacccgg

SEQ ID NO: 388981 - DNA, 539 bp, Homo sapiens
  misc_feature: GZ8MTXP01BJ452.44.23.C01.1.454.CMB.2.raw
  modified_base (243)..(243): a, c, t, g, unknown or other
  modified_base (274)..(274): a, c, t, g, unknown or other
  modified_base (394)..(394): a, c, t, g, unknown or other
  modified_base (397)..(397): a, c, t, g, unknown or other
  modified_base (491)..(491): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggngctgttgcctggtttacaacgaaaagggggnaggcccctaaaggtcctcgtctctcgtagaaaccagactgggaaggtagacgtcccgtcaggttcagtgccagtccaggtggtcgggcccgagtccatctcaacatgcactgcgctgagntcngcacttattctgtacagcagtatcatagtcgtcccggttctacgtttcggaccgtagggaccaagctagggaaactacgaaacgactggcgcgngcacatcttgttcttctaacttcctcccgctacttcttcgaatttaac

SEQ ID NO: 388982 - DNA, 656 bp, Homo sapiens
  misc_feature: GZ8MTXP01DFSDV.44.23.C01.1.454.CMB.2.raw
  modified_base (264)..(264): a, c, t, g, unknown or other
  modified_base (323)..(323): a, c, t, g, unknown or other
  modified_base (370)..(370): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagttccatcagttctgatctatttcgttggggctggacgtccggcgacgcccccggaggggagggaagngggagtggattggtgacatcattagtacgtgggacgacgtactactcgtccgtccctanaagcgtccgtctcacctagtttcgacggtacacgtcatcgaaccccncttctcctagaacctcgacctcgcgacccgcgacgacgacggtcgtttattctgtcgcggaggcggtagtacgttcggttactttacgaaactcgtaaggtcgggggtcccgtgggggtaaccctcccgttcggttacctcgtcgttccctccgtacgtccgtacccttcccaaccgacggtaacccctagttcccgggtcccttcccccggtgccccgttacccgttcgcccgttaaccggaacggtccgccgtaccgttccgggtcgggggaactaacccgggg

SEQ ID NO: 388983 - DNA, 687 bp, Homo sapiens
  misc_feature: GZ8MTXP01B4683.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacggcccccgaggggagggaagtggaggtggagttggtgacatccagttatacgtgggcgacgtactacctctcccgtcctacaagtacgtcgtactcacctagtttacgagggacacgtccatcgaaccccgtcttctccctacgaaacctcgaccctcgtacgacccgccgccggacgtaccggtctttacttcgtagtcggacgaggcgacgtacgttcggtactttacaacgttcgtacggtcggggtccgtcggggtcctacccgttcggtacctaccgttcggttccctaccgtccgacgtcccttacccgaaccgaaaccgggtccctaacgttcccgggttccccttcccccggtcggtccccgttcccccgttcggaccccgttcccgaaccgggtaaccgtaccccgtccggttccgggttccgggggcccaacccgggg

SEQ ID NO: 388984 - DNA, 669 bp, Homo sapiens
  misc_feature: GZ8MTXP01DJ0VH.44.23.C01.1.454.CMB.2.raw
tcagacagtatatacacgaccggtgctcgatttagtacacgtgattagggattggggcagggtgaacacctgtggtttttcctcctgctggtggcagctcccatatgggtcctgtcccaggtgcagctgcaggagtcgggcccaggactggtgaggccttcgggaaccctgtctctcatctgcactgtctctggtagtttccatctagttctgatctattcgttggggctggatccggcacgccccgagggagggatggagtggagtggtgactatcctaattagtacgtggggacgtacgtacctactcctcccgtccctacgaacgacgttccgtctcacctagtttacggacggacacgtaccagtcgaaccccgtccttactccctagtaaacctcgaccttccggcgacccggcccgcggtaccgcggttcgtttacttcgtgtcgcggacggcgagtacgttggttactttacgaacgttcgtacggtcgggggtaccgtcggggtcctacccggttggtcctacgttcgtccctcctacgcgttcccttaccgaacccggaacggtccctacgttccggttccccttccccgtcgggcccttccccgttgccctaaccgacggtaaccgcccgtaccggttcgggtcggggcctaacccggg

SEQ ID NO: 388985 - DNA, 599 bp, Homo sapiens
  misc_feature: GZ8MTXP01BUAW3.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcagccccgagggagggaatggagtggatggtgacagtccattatacgtgggcgacgtactactctccgtcctcaagacgtcgtctcacctatttcggaggactacgtccatcgaaccccgtcttctccctagaaactcgacctcgtcgaccgcccgcgacacggtcgttattcagtgcgagcgagacgtgtcttcaatctagtgggccgtcgggctaccctggtcacgtcgtctcctactacgtccttacccaccgtaacggggtccctaacgttcccgggtccttcccccgtcggtcccgttaccccgttcgttcccgttcccgaaacgggtcgcccgacccgttccgggtcgggggcctaacccgg

SEQ ID NO: 388986 - DNA, 612 bp, Homo sapiens
  misc_feature: GZ8MTXP01BBIRW.44.23.C01.1.454.CMB.2.raw
  modified_base (241)..(241): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgccttggtttacaaacgaaaaagggggagaggacccctaaaggtcctcgtctctcgtagaaaccagactagggaaaggtagacgtccccgtaccaggttcaaggttgccgagtccgagggtggtcggggcccggagtcactctcaaaccatgcgacctgcgcctgaagattctgactaacttatttctgtacagtcagtatacaatagtcgtaccccgggttctaacgttttcgggaccgtaagggggaccaaagcgtaacggaaaactacgaaaaacgtaactggttaacggcttggaccacgtaacttcttcgttcctttccgaactttcccttccccgtacctattccttaaggaactttaa

SEQ ID NO: 388987 - DNA, 598 bp, Homo sapiens
  misc_feature: GZ8MTXP01ARAJP.44.23.C01.1.454.CMB.2.raw
  modified_base (272)..(272): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatgggagtggattggtgacanccattatacgtggggcgacgtactactctccgtccctcaagagtcgtctcaccatttcgagggacacgtccatcgaaccccgcttctccctgaaacctcgacctccgtcgacccgcccgcggacacggtccgtttatttctgtgcgaggcgagacgtggttctttcgaattctagtcggggccgtggggctaccgtggtctactgtcctcctcacgtccttccaccgaacgggtcccaacgttccgggttcccttcccccgtcggtcccgttccccgttcgccctcccgacggcgccgacccgttccggtcgggggccaacccggg

SEQ ID NO: 388988 - DNA, 715 bp, Homo sapiens
  misc_feature: GZ8MTXP01DXKF1.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctatttcgttggggctggactccggcacggcccccggaggggagggaagtgggagtggagttggtgacatccagttatacgtgggacgtacgtacctactcctcccgtaccctacgaagtcgtccgttctacctacctacgtttacggacggacctacgtaccagtaccgaacccccgttccttaccgtaccctacgaaaccttccgaaccctcccggtacgacccggtcccgggaccggtaaccgtccggggttaccttttacgtttccgtggtcggacggtacgggcgtacgtacgttggtttccttacgaacttcgtacggtcgggtccgtacggggcctacccgttgtaccgtacgtcgtccttcgacgtacgtcccttaccgaccgaacgggtccctacgttcccgttccccgttaccccgtcggtccccgttcccgttcgttcccctccggaacgccgtacccgtccggttcggtccgggggaaccaacccgggg

SEQ ID NO: 388989 - DNA, 786 bp, Homo sapiens
  misc_feature: GZ8MTXP01BA9LR.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagttccatcagttctgatctattcgttgggctggactccggcacggccccgaggggacgggagtggagtggtagttggtgactatccagttatacggtggggacgtaacgtactactcctccgtcccgtacaagtacgtcgtcctactacctacgttacgtacggacgacgtacctacgtacgtaccccgtaccgttactacccgtacgtaaccgtaaccgtacccgtcccgtcgacccggcccgacccggtaccgtaccggtaccgtttacgtttctcggtacgtcgggacggtacggtacgttaaccgttcgtttaccgtttaagtaaaccgttacggttaacggttcggggggtaccccggttcggggtaacccgtccccggtttcggttaccgtaccgtttccggtcccttacccggttcctaacggtcccctttaccccgaacccgtaaaccgggggcccccttcgggttccggttcccccttttccccggccggtccccgttccccgtttcggcccgttcccgggtaaaccgggccgtaaccccgtacccggtttacccggggccggggggaacaacccccgggg

SEQ ID NO: 388990 - DNA, 570 bp, Homo sapiens
  misc_feature: GZ8MTXP01AEI6H.44.23.C01.1.454.CMB.2.raw
  modified_base (299)..(299): a, c, t, g, unknown or other
  modified_base (345)..(345): a, c, t, g, unknown or other
  modified_base (363)..(363): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggatccggcacgccccgagggagggatggagtggattggngacatccattatacgtgggcgacgtactactctccgtcctcaacgngtcgtctcactaattcgngggacacgtcatcgaaccgtcttctccctagaaactcgacctccgtcgacccgccgcgacacggtcctttattcgtgtcggcgaggcgaagtcttggttctttacaacttcgtaggtcgggggtccgttcggcctacccgttggtccacgttcgtccttccgttcacgtcctaccaaccgacggcccacgtccggttccttccccgg

SEQ ID NO: 388991 - DNA, 683 bp, Homo sapiens
  misc_feature: GZ8MTXP01CFHHO.44.23.C01.1.454.CMB.2.raw
  modified_base (473)..(473): a, c, t, g, unknown or other
  modified_base (563)..(563): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatctattcgttggggctggactccggcacgccccgaggggaggggaagtgggagtggtagttggtgacatcctattagtacgtggggacgtacggttacctactccgtcccgtaccctacgaagtacgtccgtctcctacctacgtttacggagggaccaccgtaccacgtacgaacccccgtccttcctaccctacgaactcgtacccctcggtcgacccggccggccggaccgtaccggtccgtttattcgtgtggacggnggcgaggtacgttcggttacttacgaacgttcgttacggtcggggtccgtcggggtcccgtaccggtcggtcctacgtcgtcctcctacncgtccttaccgaccgacgggccctaccgttccggttccccttccccgtcggtcccgttccccgttcgcccgttaaccggacgaaccgcccgtaccgttcgggtccgggggccaacccggg

SEQ ID NO: 388992 - DNA, 701 bp, Homo sapiens
  misc_feature: GZ8MTXP01DX9H1.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggtatttccatctagttctgatctattcgttgggctggatccggcacggccccgaggggagggagtggtaggtggatggtgacactctattatacggtgggcgacgtactactccttccgtcctcaacgtcgtcgtccgtcacctaacttacgaacggactacgtcctactacgaccgtcttcctcctactaaacgtcgtacccgtccgtacggtacccggcccggaccggtaccgaccgggttaccgtttactttcgtcgggttacgggacgggtacggggtccgtaacgggttaccgttcggttaccgtttacgttaaacgttccggttaagggttccgggggtccccggttacggtcccggttaacccgttcggggtccttaccgttccggttccttcccgttcgttacggtcccctttacccgaacccggtaacccgggccgttacccggtccggtttccccgttccccccggg

SEQ ID NO: 388993 - DNA, 719 bp, Homo sapiens
  misc_feature: GZ8MTXP01COW4Q.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggtactttccatctagttctgtactctagttcgttggggctggactccggcacgccccgagggagggagtggagtggtatggtgacatcctattagtacgtgggggacgtacgtactaccgtctccgtcctacaacgtacgtcgtctacacctaacgtttcgaacggactaccgtacactcgaaccctcttcctacccgtacgaaacctcgtacccgtccggtcgtaccccggcccggaccggtaccgtacccgggttccgtttaacgtttccgtacggttcgggcggtacggggtccgtaacggtaccgttcggttccgtttacgtaaacgtttccgttaacgggtccgggggtcccgtccgggtaaccctaccccggttggtacccgttccgtttcggttcccgttacccttcggttaaccgttcccgttaaccccgtaaccggtaacccggggtccccttaccgttcccgggtttccccctttccccccgggg

SEQ ID NO: 388994 - DNA, 539 bp, Homo sapiens
  misc_feature: GZ8MTXP01DDB7C.44.23.C01.1.454.CMB.2.raw
  modified_base (499)..(499): a, c, t, g, unknown or other
  modified_base (515)..(515): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatacgtgggcgacgtactactctccgtcctcaagacgtcgtctcacctaactttcgaagggacacgtccatgaaccgcttacctccctgaaactcgactccgtgaccgccgcgacacggtccttagttctgtggcgtaggcgagactggtctttcaaatcgtagtgggtcctggctacccgttggtcacgtntcttccttcagtctcnccaagggcccatcgttcttccccg

SEQ ID NO: 388995 - DNA, 610 bp, Homo sapiens
  misc_feature: GZ8MTXP01CB9D7.44.23.C01.1.454.CMB.2.raw
  modified_base (342)..(342): a, c, t, g, unknown or other
  modified_base (368)..(368): a, c, t, g, unknown or other
tcagacagtatatacacgaccggtgctcgatttagtacacgtgattagggattgggggctttctgagagtcaaggacctcctgtgcaagaacatgaagcacctgtggtttttcctcttgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgccccgagggagggagtggaggtggatggtgacatcctattatacgtgggcgtacgtactactctccgtccncaacgtatcgtctcacctaatttcgngggacacgtccatcgaacctctctccctagaaacctcgtaacctccgtacgacccgccggcgtacgaccggttcgtttacttcgtgttcggggacggaacggcgtacgacgttggttcctttagtaatcgttaggtcggggtccgtggcctacccgttgggtccttcgtcggtccttcccgttcgaccgtccttcccgaacgaccggggccccttacgttcccggttcccgtttcccccggg

SEQ ID NO: 388996 - DNA, 691 bp, Homo sapiens
  misc_feature: GZ8MTXP01ACGJC.44.23.C01.1.454.CMB.2.raw
  modified_base (553)..(553): a, c, t, g, unknown or other
  modified_base (622)..(622): a, c, t, g, unknown or other
  modified_base (652)..(652): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttggggctggactccggcagccccgagggaggggaatgggagtggtattggtgacagtcctattagtacgtggggcgtacgtacctactccgtcccgtccctacaagtacgtcgtcctacctacctacgtttcggacgggtacctacggttcccagtaccggaacccccgtcctttccgtaccctaggaaacccttcgaaccctcccgtacgaccccggccgaccggtacgtaccggtccgttttacttccgtggtcgcggacggtcgagtaccgttggttactttcgaacttcgtaggttcgggggccgttcggggcctacccggtggttaccncgttcgtcctccttacacgtccttaccaaccgacgggtcccctaagttcccgggtacccctttccccgnggtccccgcccgttacgcccgttaacccgngggtaaccccgccgtcccggttcgggtccgggcgaaccg

SEQ ID NO: 388997 - DNA, 654 bp, Homo sapiens
  misc_feature: GZ8MTXP01A9SHF.44.23.C01.1.454.CMB.2.raw
  modified_base (304)..(304): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgatctattcgttggggctggatccggcacgccccgagggagggagtggagtggatggngacatctattagtacgtgggacacgtactactctccgtcctcacgtcgtcgtctcaccctaagtttaccggaaggtacctaccgtaccactaccgaacccgtcttaccctccctacgtaaacctcgtaacccgtcccgtacggacccgcccggacggtaccgtaccgggtcgtttacgtttcgtggtcgggtacgggagggacgtacggttacgtcggttcctttacgtaacttcgtacggtcgggggtcccggtcggtccgtacccgttcggtcttacgttcgttccttccgttcgttacgtccttccgaaccgtacgggcccttacgttcccggttcccgttccccgg

SEQ ID NO: 388998 - DNA, 584 bp, Homo sapiens
  misc_feature: GZ8MTXP01DHSJT.44.23.C01.1.454.CMB.2.raw
tcagacagtatatacacgaccggtgctcgatttagtacacgtgattagggattggggctttctgagagtcaaggacctcctgtgcaagaacatgaagcacctgtggtttttcctctgctggtggcagctcccagatgggtcctgtcccaggtgcagctgcaggagtcgggcccaggactggtgaggccttcgggaaccctgtctctcatctgcactgtctctggtatttccatctagtttctgatctattcgttggggctggatccggcacgccccgagggagggagtggagtggattggtgactatacctatttagtacgtggggaccgtaacgtactactctcccgtcctcgaacgcgtacgtctccacctaatttcgcgggacacggtccagtcgaacctcttcctcctagaactcgacctccgtcgaccgtccgcgacgacggtcctttattcgtcgtggcggaggcgagtactggtctttcaaatcgtagtcggggcgtcggtcctaccgttggtccttagtcgttccttccgttcacgtccttcccaacgacgcccagttcccgttccgtttccccgg

SEQ ID NO: 388999 - DNA, 584 bp, Homo sapiens
  misc_feature: GZ8MTXP01DJP98.44.23.C01.1.454.CMB.2.raw
  modified_base (276)..(276): a, c, t, g, unknown or other
  modified_base (380)..(380): a, c, t, g, unknown or other
  modified_base (408)..(408): a, c, t, g, unknown or other
  modified_base (538)..(538): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcgggtgctgttgccttggtttacaaacgtaaaagggggnacggcccctaaggtcctcgtctctcgtagaaaccagacgtggaaggtagacgtcccgtcaggttcagtgccagtccgaggtggtgggccccggagtccagtccncaacccattcggcgacctgcgcctgaancttctgtactaacttatttctgtacagctagtatactagtacgtccgtccccggtttactacgttttcggaccgtagggaacccaagcgtaaggaaactacgaaacgacgtgtggacttggaccaccgtnttcttacgttcttctaacttcctcccgctattctaagttaattaac

SEQ ID NO: 389000 - DNA, 575 bp, Homo sapiens
  misc_feature: GZ8MTXP01DCGLA.44.23.C01.1.454.CMB.2.raw
  modified_base (224)..(224): a, c, t, g, unknown or other
  modified_base (243)..(243): a, c, t, g, unknown or other
  modified_base (252)..(252): a, c, t, g, unknown or other
  modified_base (299)..(299): a, c, t, g, unknown or other
  modified_base (399)..(399): a, c, t, g, unknown or other
  modified_base (476)..(476): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagcctccagatgggtcctgtcccaggtgcagctgcaggagtcgggcccaggactggtgacggccttcgggaaccctgtctctcatctgcactgtctntggtatttccatcagttcngatctattntgggctggatcggcacgccccgagggagggaatggagtggagttggngacatcattatacgtggggcacgtactactctccgtccctcaagacgtcgtctcacctaatttcgaagggacacgtccatcgaaccgtcttcctccctanaaactcgaacctccgtcgaccgccgcggacacgtacgttcttactcgtgggcgaggacggacgacgtcgttcgtttntaactacgtagtcggtcgggtcggtcgtacccttcggtcgcctcgtcgttccttcacgctccctaacccgacggacccgctcggttcccgtttcccccg

SEQ ID NO: 389001 - DNA, 718 bp, Homo sapiens
  misc_feature: GZ8MTXP01DZH2J.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgtatctattcgttggggctggactccggcacgccccgagggagggaagtggagtggtagttggtgactatccgtattagtacgtggggacgtacgtactactccgtccgtccctacgaacgtacgttcgtctcctacctaacgtttcgaacgggactaccgtacctagtaccgaacccgtctttaccctaccctacgtaaaccgtcgacccttccggtacgtaaccccgccgtaccggaccgtacccgggttaccgtttagttccgtggttcggggacggtacgggaccgtaacgtaacgttcggttacctttacgtaaacgttccgttaacgggtcggggtcccgttcgggtcccttaacccggttgggttacccttcgtttccggtcccttccgttccgttaacggtcccctttacccgaacccggtaaccggggtccccttacggttccccggttccccgtttccccccggg

SEQ ID NO: 389002 - DNA, 592 bp, Homo sapiens
  misc_feature: GZ8MTXP01CL0QC.44.23.C01.1.454.CMB.2.raw
  modified_base (489)..(489): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggatccggcacgccccgaggggaggggaatgggagtggattggtgacatccattatacgtggggcgacgtactactctccgtccctcaagagtcgtctcaccatttcgagggacacgtccatcgaaccccgcttctccctgaaacctcgaccctccgtcgacccgccgcggacacggtccgtttattccgtgtgcgtaggcgagtacgtggttcttcaatcgtagtggggccgtggggctacccgtggtcactcgtcctcctcncgtccttccaccgtaacgggccctacgttccggttcccttcccccgtggcccgcccgttcgccctccgaggaaccgccgtaccgttcggtcggggcaaccggg

SEQ ID NO: 389003 - DNA, 707 bp, Homo sapiens
  misc_feature: GZ8MTXP01BYS02.44.23.C01.1.454.CMB.2.raw
  modified_base (223)..(223): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgctactgtctntggtatttccatctagttctgattctattcgtgggctggactccggcacgccccgagggacgggatggagtggtagtggtgactatcctattagtacgtggggacgtaacgtacctacttcctccggtccctacgtaacggacgttcggtacctccaaccgttaagtttacgggaacgggacctacccgggtacctacgtaccgaaacccggttccttaccctaccctacgtaaaacctccgtaacccgttcccgtacgaccccggcccggaccggtacccggtaccggttacccgtttaagtttccgtcggttcggggacggtaagggtccgtaacgttaccgttggttacctttacgaaacttcgtaacggtcggggtccgtcggccctacccgttgggtcttaccgttcgtccttccgttcgttaccgtcccttccgaaccgtaaccgggtcccttacgttcccggttcccttcccccggg

SEQ ID NO: 389004 - DNA, 533 bp, Homo sapiens
  misc_feature: GZ8MTXP01BA47N.44.23.C01.1.454.CMB.2.raw
  modified_base (445)..(445): a, c, t, g, unknown or other
  modified_base (461)..(461): a, c, t, g, unknown or other
  modified_base (463)..(463): a, c, t, g, unknown or other
  modified_base (465)..(465): a, c, t, g, unknown or other
  modified_base (475)..(475): a, c, t, g, unknown or other
  modified_base (482)..(482): a, c, t, g, unknown or other
  modified_base (487)..(487): a, c, t, g, unknown or other
  modified_base (490)..(490): a, c, t, g, unknown or other
  modified_base (493)..(493): a, c, t, g, unknown or other
  modified_base (497)..(497): a, c, t, g, unknown or other
  modified_base (505)..(506): a, c, t, g, unknown or other
  modified_base (508)..(508): a, c, t, g, unknown or other
  modified_base (512)..(512): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgatctattcttgggggctggatcccgggcacgcccccgaggggaggggaatgggagtggattggtgacatccattatacgtgggggcacgtactactctccgtcctcaacgacgtcgtctcacctaatttcgaagggtacaccggtccatcgtaacccgctttcctccctagaaacctgacctccgtgacccgcgcgacncgtcttatctgtgcgngngngactgtcttnatctagngggcngcncgngtcngtgcttcnncnctcncacggccagtcgttctccccg

SEQ ID NO: 389005 - DNA, 625 bp, Homo sapiens
  misc_feature: GZ8MTXP01C5G41.44.23.C01.1.454.CMB.2.raw
  modified_base (446)..(446): a, c, t, g, unknown or other
  modified_base (459)..(459): a, c, t, g, unknown or other
tcagacagtatatacacgaccggtgctcgatttagtacacgtgattagggattggggggagtcagaccctgtcaggggacagcatggacatgagggtccccgctcagctcctggggctcctgctgctctggctcccaggttcgagatgtgacatcgagatgacccagtctccttccttctgttcttcttctggttggaggcagcgtcaccatcacttggccgggcgagtcgtagggttcgttttcgggtgtcttggttcgcccgttgggtttaaccgaaaacggtaaaaaaggggggacgacgggacccccttaagggtccctcgtctcgtcgtagaaaccagactgggaagtagacgtcccgtcaggttcagtcgccgagtccgagggtgggtcgggccccggtagtccactcacaacctattcgcgacctggcgcctagaaacnttctgctaacttnttctgtacagactagtatctatagtccgtcccgtttctacgtttcggaccgacggggtaccaagcgtaaggaaacttacgaaacgtaacgtggtcgtcgttcggaccaccgtacttacttcgttcttctaacttcccgttcccactattcttaacgttaatttaac

SEQ ID NO: 389006 - DNA, 614 bp, Homo sapiens
  misc_feature: GZ8MTXP01ARRO5.44.23.C01.1.454.CMB.2.raw
  modified_base (217)..(217): a, c, t, g, unknown or other
  modified_base (233)..(233): a, c, t, g, unknown or other
  modified_base (257)..(257): a, c, t, g, unknown or other
  modified_base (363)..(363): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcttctgtcttcttctgttggagcagctcacatcacttgccgggnagtcaggttcgtttgnctgtgctggttacaagaaaggggnacggcccctaaggtcctcgtctctcgacgaaacagactgggaagtagacgtcccgtcgaggttcagtgcctagtccgagggtggtcgggccccggagtccacgtcncaaacctattcgcgaccgtgccggtcctaggaagtcttctgactaactttattctagtacagctagtatactagtgtaccgtcccggttctaccgtttcggaccgtagggaccaacgtcgtaaagggaaacttaccgaaaacgtaaccgttggtaacggtaaccgttcggacccttaaccggtaacttccgttcggttcctttcctaaccttcccgttaaccccgtactacttccttaagttaatttaacg

SEQ ID NO: 389007 - DNA, 611 bp, Homo sapiens
  misc_feature: GZ8MTXP01B91GG.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttggggctggactccggcacggcccccgagggagggagtggagtggagttggtgacatcctattatacgtggggactacgtactactcctccgtccctacaacgcgtcgtctccactaacgtttcgaagggacctacgtccactacgaaccgtcttcctccctagaaacctcgaccctccgacgaccgcccgcgaccgacggttccgtttacttcgtagtcggcggaggcgacgtacgtgtctttacaacgttctaggtcggggtcctggcctaccgttggtccacgttcggtcttcccgttcgaccgtccttaccgaaccgtaacgggcccttacgttcccgttcccgttcccccgg

SEQ ID NO: 389008 - DNA, 570 bp, Homo sapiens
  misc_feature: GZ8MTXP01B3E3Q.44.23.C01.1.454.CMB.2.raw
  modified_base (277)..(277): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgaacatcgagatgacccagtctccttccttcctgtcttcttctgttggaggcagcgtcaccatcacttggccgggcgagtcaggttcgttttcggtgctgttgccgtggtttacaaacgaaaagggggngaggcccctaaggtcctcgtctctcgtagaaaccagactgggaaggtagacgtcccgtcaggttcagtgccagtccagggtggtcgggccccggagtccactctcaaccattcgcgacctgccggcctagaagtcttctgactaacttatttctgtacagctagtatcatacgtcgtccccggttctacgttttcggacgtacgggaccagcgtaaggaaatacaaacgactggtggcttgcaccgtatcttgttccttctaacttccgttcccgctacttcgtgaacttaac

SEQ ID NO: 389009 - DNA, 644 bp, Homo sapiens
  misc_feature: GZ8MTXP01BVGL1.44.23.C01.1.454.CMB.2.raw
  modified_base (516)..(516): a, c, t, g, unknown or other
  modified_base (612)..(612): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatctagttctgatctattcgttggggctggactccggcacgccccgagggagggaagtgggagtggagttggtgacatccattagtacgtgggacgtacgtactactcctccgtccctacaagacgtcgtctcactactttcgagggactacgtcatcgaacccctcttactcctacgaactcaccctccgtcgacccggccgaccggtacctacgggtccgtttattcgtgcgcggtagcgtagtacgttggttcttacgaactcgtaggtcggggtcccgttcggggcctaccgttgtcctacgtcgtcctccncctacgtccttacccgaaccgtacgggcccctacgttcccggttccccttcccccgtgggtccccttccgttcgccccgttaaccgacggtaaccncctacccggttcggtaacggggcctaaccggg

SEQ ID NO: 389010 - DNA, 575 bp, Homo sapiens
  misc_feature: GZ8MTXP01C40ET.44.23.C01.1.454.CMB.2.raw
  modified_base (298)..(298): a, c, t, g, unknown or other
  modified_base (423)..(423): a, c, t, g, unknown or other
  modified_base (458)..(458): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtccaggtgcagctgcaggagtcgggccaggactggtgaggccttcgggaaccctgtctctcatctgctactgtctctggtactttccatctagttctgatctattcgtgggctggactcggcacgcccgagggaggagtggagtggtatggngacatcattatacgtggctaacgtactactctccgtcctacgaacgtacgtcgtctacctacgtaagtttcgaacgggacaccgttacacgtcgaaccgtcttcaccttagaaactcgacctcgngaccgcgcgtacgacggtctttatcgtgcgtacgngcgagtacgtgtcttacaaatcgtacgtgggtccgtcgctacccgttggtccacgttcgtcttccttggcttcctaaccgaacgaaccgggtcccttacgtcccgttcccgtccccg

SEQ ID NO: 389011 - DNA, 672 bp, Homo sapiens
  misc_feature: GZ8MTXP01AMIKM.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgatctattcgtgggctggactccggcacgccccgagggagggaagtggagtggagttggtagacatcctattagtacgtgggcgtacgtactacctctccgtcctacgaacgtacgtcgtctacacctaagtttaccggaaggtaccaccgtaccacgtacgaacccgtcttacctcccgtagtaaacctcgtacccttccggtacgaccccggccggaccggaccgtaccggttaccgtttatttccgtggtcggggcggagggccgtaggtaccgttcgggttctttacgtaaagttcgtacggtcgggggtccgtacgggtccctacccgttcgggtaccttccgttcgtcccgttcccttcgcgtcccttacccgaacccgtaaccgggtcccttacgttccccggttcccgttccccccggg

SEQ ID NO: 389012 - DNA, 618 bp, Homo sapiens
  misc_feature: GZ8MTXP01DOUPO.44.23.C01.1.454.CMB.2.raw
  modified_base (274)..(274): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctatttcgttggggctggatccggcacggccccgaggggagggaagtggagtggagtggngacatccattatacgtgggcgacgtactactctcccgtccctcaagcgtcgtctcactatttcgacggacacgtcatcgaacccgtctctcctagaacctcgaccctccgtacgacccgccgacgaccgtacggtcgtttacttctgtcgcgaggcgagtacgttgttcttacgaattcgtagtcggggccgtcgggcctaccgtgtccacttcgtcctcctcacgtccttacccgaaccgacgggccctacgttcccggttccccttcccccgtgggtccccttcccgttcgttcccgtaaccgaggccgtacccgccgttcgggtaaccggggccaaccggg

SEQ ID NO: 389013 - DNA, 639 bp, Homo sapiens
  misc_feature: GZ8MTXP01AK63V.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacggccccgaggggaggggaagtgggagtggagttggtgactatcctattatacgtgggacgacgtactactcctccgtccctacaagacgtcgtctcacctattcggacggacacgtcatcgaaccccgtctactccctacgtaactacgaccctccgtcgacccggccgccgacgtaccggtctttacttcgtgtggcgaggcgagtacgtggttacttacgaattcgtagtcggggtccgtcggggcctacccgttgtcctacgttcgtcctcccgtcgacgtccttacccgaaccgaccgggtccctacgttcccggttcccttcccccggtgtccccgttcccgttcgcccgtccgacggccgtcccgaccggttcggtcggggccctaaccggg

SEQ ID NO: 389014 - DNA, 619 bp, Homo sapiens
  misc_feature: GZ8MTXP01B5M59.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggatccggcacgccccgagggagggatggagtggatggtgacatccattatacgtgggcgacgtactactctccgtccctcaagacgtcgtctcacctatttcgagggacacgtccatcgaaccccgtcttactccctacgaaactcgaaccctccgtacgacccgcccgaccgacgtaccggtccgtttattcgtagtcgcgaggcgagacttggtcttacaatctagtcgggcgtcgggctaccgtggtccactcgtcctcctacgcgtccttacccgaacctaaccggggcccctaacgttcccggttccctttcccccgtcggccccgttccccgttcgcccgttaacccgacgggccgccctaccggttccggtcgggggcctaaccggg

SEQ ID NO: 389015 - DNA, 647 bp, Homo sapiens
  misc_feature: GZ8MTXP01AYGCU.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacggccccgaggggaggggaagtgggagtggtagttggtgacatcctattagtacgtagggacgtacgtactactcctcccgtccctacgaagtcgtcgtctcacctacgtttcggacggtacacgtcatacgaaccccgtcttcctcccgtacgaaacctcgaccctccgtcgcccgcccggcgtaccgacgtcgtttatcgtgtcggcgaggcagtacgtcggttcttacgatcgtaggtcggggtaccgtcggggactacccgttggtcctacgttccgtcctccctcgtcgtcccgtttacccacccggaacgggtcccctacggttccccggttccccttccccggtcggcccgttcccgttgaccctccgacggcaccgtcccgttcgggtcggggcaaccgg

SEQ ID NO: 389016 - DNA, 646 bp, Homo sapiens
  misc_feature: GZ8MTXP01CFB3E.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggtagtttccatctagttctgatctattcgttggggctggactccggcacggccccgagggagggagtggagtggagtggtgactatccgtattagtcgtacgggcgtaacgtactaccgtcctaccgtccctacgaacgtacgtcgtctaccacctaacgtttacgaacgggactacgtccagtcgaaccgtcttaccgtccctagaacctcgaccgtccgtacgacccggccggtacggaccgtaccggttacgtttactttcgtcgtcgggacgggtaggccgtacgtacgttcgttcgttagtacgtcgtaggtcggggaccgtcggccctaccgttgtaccgttcgttcggtccttcccgttcgaccgttccttacccgaacgaccggtcccgttacgtcccggttcccttccccggg

SEQ ID NO: 389017 - DNA, 646 bp, Homo sapiens
  misc_feature: GZ8MTXP01ARCFQ.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacgccccgaggggagggagtggagtggagttggtgacatccattagtacgtgggacgacgtactactcctccgtccctacaagacgtcgtctcacctagtttcggacggacaccgtccatcgaaccccgtcttctaccctacgaaacctcgaccctccgtcgacccggccgaccggacgtaccgggtcgtttacttcgtgtggcgaggcgagtacgttggttcttacaattcgtaggtcggggtccgtcggggcctaccgtggtcctacgtcgtcctcctctacttccttacccaaccgacgggtcccctacgttcccggttccccttcccccgtcggtccccgttccccgttcgttcccgtccgacgggcccgccgtacccgttcgggtcgggggaaccaaccggg

SEQ ID NO: 389018 - DNA, 618 bp, Homo sapiens
  misc_feature: GZ8MTXP01A4LPL.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatgggagtggagttggtgacatccattatacgtggggcgacgtactactcctccgtccctcaagacgtcgtctcacctatttcgagggacacgtccatcgaaccccgcttctccctagaactcgaccctccgtcgacccgccggcgaccacgggtccgtttactttcgtgtgcgaggcgagacgtcgttcttcatctagtcggggccgtggggctacccgtggtcctacgtcgtcctcctcgtacgtccttacccgaacccgtacggggcccctaacgttcccgggtcccctttccccccgtggtccccggccccgttcgccctccgacggtaacgccacccgttccggtcgggggccaaccggg

SEQ ID NO: 389019 - DNA, 646 bp, Homo sapiens
  misc_feature: GZ8MTXP01DKDT1.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgattctagtttcgttggggctggactccggcgacggcccccgagggggaggggaagtgggagtggtagttggtgacatcctattagtacgtgggcgtacgtactactcctccgtccctacaagtcgtcgtctcacctatttcgagggacacgtccatcgaaccccgtcttctaccctagaaactcgaccctccgtcgacccgcccggcggaccgtacggttcgtttactttcgtgtcgcgaggcgacgtacgttcggttactttacgaattcgtaggtcggggtaccgtcggggtcctacccgttgtccacgttcgtcctcctctacgtccttcccgaaccgtacgggcccctacgttcccggttcccttccccgtcggcccgttcccgttcgcctccgacggccgccacccgttcggtccggggctaacccggg

SEQ ID NO: 389020 - DNA, 564 bp, Homo sapiens
  misc_feature: GZ8MTXP01E17HR.44.23.C01.1.454.CMB.2.raw
  modified_base (297)..(297): a, c, t, g, unknown or other
  modified_base (504)..(504): a, c, t, g, unknown or other
  modified_base (515)..(515): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaagtggagtggattggngacagtccattatacgtgggcacgtactacttctccgtccctcgaacgagtcgtctcacctaagtttcgaacgggtacacgtccagtacgaaccgtcttctccctagaaactcgacctcgtcgacccgccgacgacacggtcctttattctgtcggtgacggcgagactggtcttacgatctagtcgggctgggccaccgttggacncgtcgtcttcncagtccttacccgaaccgaacgggcccttacgtccgttccgttccccgg

SEQ ID NO: 389021 - DNA, 596 bp, Homo sapiens
  misc_feature: GZ8MTXP01BS40I.44.23.C01.1.454.CMB.2.raw
  modified_base (377)..(377): a, c, t, g, unknown or other
  modified_base (539)..(539): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaccctgtctctcatctgcactgtctcgtggtactttccatctagttctgatctagttcgttggggctggactcggcacgccccgagggacgggaatggagtggattggtgacagtccattatacgtgggcgacgttactactcctccgtcctacgaacgagtcgtctcactaacgtttcggnggacacgtcctacgcgtaaccgtcttacctccctagaaacctcgacctccgtcgaccgcgcgtacacgttcgttattcgtagtgggcgaggccgagtacgtcggttctttcgtaatcgtagggtcgggccgttggaacctccgttggtcacgttcggttccnccgttcacggtcccttcgaacccgtaacgggcccttacgtccggttcccttccccgg

SEQ ID NO: 389022 - DNA, 663 bp, Homo sapiens
  misc_feature: GZ8MTXP01CI5YT.44.23.C01.1.454.CMB.2.raw
  modified_base (240)..(240): a, c, t, g, unknown or other
  modified_base (350)..(350): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtccaggtgcagctgcaggagtcgggccaggactggtgaggccttcgggaaccctgtctctcatctgcactgtctctggatttccatcagtttcngatctattcgttggggctggactcggcacggccccgagggagggagtggagtggtagttggtgactatcctaagttatacgtgggacgtacgtactactctccgtcctanaacgcgtcgtctactactaacttcgaacggacacgtacctataccgaaccgtcgttacctaccctaggaaacctcgtaaccctcgtaccggaccgcccggacggtaccgtaaccgggttccgtttaacttcgtgtcggggcggtaggcgtacgtaacgttcggttaccttactaaacgtcgttaacggcgggtccggtcggccgttaacccgttgggttaccttacgttcgttcccgttccttcgttccgttaaccttaacccgaaccggtaaacgggccccttacgtttcccggttccccgtttcccccggg

SEQ ID NO: 389023 - DNA, 633 bp, Homo sapiens
  misc_feature: GZ8MTXP01C1JXF.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgcccccgaggggagggaatgggagtggattggtgactatccaattagtacgtgggcgtacgtactactctccgtccctcaagcgtcgtcctacacctagtttcgacgggtacacgtaccatcgaacccccgtcttacctccctagaaacctaccgaccctcccgtcgacccgtcccgacggacctacgggtccgtttatttctcgtcggtcgaggcgtagacgttggttactttcgaaagttctagtcggggtccgtggggtcacccgtcgtcgtactcgtcctctcacgtccttaccgaccgaaccggcctacgttccgttcccttccccgtccggcccgttcccgttcgccgtccgaacgccgcgtacccgttcggtccgggggcaacccggg

SEQ ID NO: 389024 - DNA, 692 bp, Homo sapiens
  misc_feature: GZ8MTXP01EYQNE.44.23.C01.1.454.CMB.2.raw
  modified_base (448)..(448): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctatttcgttggggctggactccggcgacggccccggaggggaggggaagtgggaggtggagttggtagactatcctaagttagtacggtgggacgtacgtactactcctcccgtccctacgaacgtacgtccgtctactacctagtttcggacggacctacgtccagtacgacccctcttactcctagaacctcgacctcgtcgaccgccgacgacgtacggtctttatcgngtcgcggagcgagtacgtggttacttacaagttcgtagggtcggggcctcggggcctaccccggtggtacctacgttcgtacccttctaccgtacgtccccgttacccgaaaccgggtaacccggggtccccttaacgggttcccccggtcccctttcccccggcgggtccccgttcccttacggccccgttaaccgggacgaaccggtcccgtaccgttcgggggcggggttcccaaccgggg

SEQ ID NO: 389025 - DNA, 729 bp, Homo sapiens
  misc_feature: GZ8MTXP01BB3IX.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtatttccatctagttctgatctattcgttgggctggatccggcacgcccccgagggacgggaagtggaggtggagttggtgactatcctattagtacgtgggacgtaacgtactacttcctccgtccctacgaacgtacgtcgtctaccaccgtaacgtttaccggaacggggtaacctaccggtacccacgttaccggtaaacccgtcctttaccctaccccgttacgtaaaacccttcgtaacccgttcccggttaccggaccccggaccgggtaccggaaccgttacccgggttcccgttttaacgtttccgttacggttcgggacggtacgggtaccgtacggttacgttcgggttcctttacgaaacgttcgtaacggtcggggtaccgtgggtccctacccgttgggtccttacgttcggtccttcccgttcgaccggtcccttacccgaacccgtacggggtccccttacgttcccggttccccgtttcccccgg

SEQ ID NO: 389026 - DNA, 607 bp, Homo sapiens
  misc_feature: GZ8MTXP01AC2E8.44.23.C01.1.454.CMB.2.raw
  modified_base (317)..(317): a, c, t, g, unknown or other
  modified_base (422)..(422): a, c, t, g, unknown or other
  modified_base (562)..(562): a, c, t, g, unknown or other
  modified_base (576)..(576): a, c, t, g, unknown or other
  modified_base (582)..(582): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttggggctggatccggcacgcccccgaggggaggggaatgggagtggattggtgacatccattatacgtgggcgtacgtactactcctccgtcccctanaagacgtcgtctcctacctatttacgagggtaccacgtccatcgaaccccgtcttctccgtagaaactcgacctccgtcgacccgcgcgactcggtctttattcngtcggcgacggcgagtactggttactttacgaattccgtagtcgggggccgtcggggcctaccccgtggtccacgttcgtcctcctcgactccttaccaccgtaacgggcccctagttcccgttccttccccgtggcccnccgttcgccctcgnggaacncgtaccttcggtcggggcaaccggg

SEQ ID NO: 389027 - DNA, 830 bp, Homo sapiens
  misc_feature: GZ8MTXP01BVZCE.44.23.C01.1.454.CMB.2.raw
  modified_base (254)..(254): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgaccagtctccttccttcctgttcttcttctggttggaggcagccgtcaccatcacgttggccgggcgtagtcgtagggttcggtttttcgggngtcttggttcggtccgttagggtttaacgaaaacgggaaaaagggggcgaacggaccccgtaaggtcctcgtctcgtacgtacgaaaccagacgtaggaaggtagaccgtcccgtacgaggttcgagtcgaccgtacggtccggaggggtcggggtacgggccccggtacgtccaccttacctacctaaaccgttaacgttaacgggacccgtaacccggttcgggacccgggtaccgtaagggaaacgttactttaccgtacgtaacctttaaccttttacgtttccgtagggttacctacgggtaacctaaggttaacttaccgtaaacgtttaaccgggtttccccgttacccccggggtttacgttttaacccgggttttaccggggaacccgggtaaacgggggtaaaccctaaacggggtaccgttaaacggggaaaactaaacccggtaaaacgtaccggttgggtaacggtccttacggaacccttaccgtagtttccttaccggtttcttaccttaaccggtttccccgtaaccccgttactacgttaccgttgttaaaactttaag

SEQ ID NO: 389028 - DNA, 698 bp, Homo sapiens
  misc_feature: GZ8MTXP01A45A7.44.23.C01.1.454.CMB.2.raw
  modified_base (663)..(663): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggactccggcacgccccgaggggagggaagtgggagtggagttggtgactatcctagttagtacgtggggacgtacgtacgtactccgtcccgtccctcgaagtacgtccgtactcctacctagtttcggacgggtacaccggtaccagtaccgtaacccccgtccttcctccccgtaagaaaccctcgaccctccggtacgaccccgtccggccggaccgtaccggtccgttttattccgtagtcggacgaggaccggtagtacgttggttaccttacgtaagtcgtaaggtcgggggtcccggttcggggtaccctacccggttcggtacctcggttccgttccctcccgtactccgtccttacccgaccgtaacgggcccctacgttcccggttcccttccccgcggtcccgttccgttcgccctcccggnggcccgtcgacccggttcggtccgggggcaaccgg

SEQ ID NO: 389029 - DNA, 637 bp, Homo sapiens
  misc_feature: GZ8MTXP01ACO61.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggaatggagtggattggtgacatccattatacgtgggacgacgtactactctccgtcctcaagacgtcgtctcacctagtttcgagggacacgtaccagtacgaaccccgtccttctaccctagaaacctacgaccctccgtacgacccggccggccggaccgtacggtccgtttacttcgtgtcggcggacgggcgtacgtacgttcggttacctttacgaacttcgtaaggtcgggggtcctcgggggcctaaccccgtgggtacctacgttcgtcccttacgtcacgtcccttaccgaccgtaacgggccctaacgttccggtccttccccgtggcccgttaccgttcgacctccgacggcgtccgacgttcggcggggcaaccggg

SEQ ID NO: 389030 - DNA, 694 bp, Homo sapiens
  misc_feature: GZ8MTXP01AP38U.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaacctgtctctcatctgcactgtctctggtagtttccatctagttctgatctattcgttggggctggactccggcacgccccgaggggagggatgggagtggagttggtgactactcctagttatacggtggggacgtacgtactactcctcccgtccctacaagtcgtccgtctaccacctatttacggagggtaccacgtccatcgaaccccgtcttctacccgtacgtaaaccgtccgtaccctccggtacgacccgccggccggtaccgtccggttaccgttttacttcgtgtcggacggaggcgtacgtacgttcggttacttacgagttcgtagggtcgggtccgtcggggcctaccggttcgtacctacgtcgtccttccgtctacgtcccttaccgaccgtaaccgggcccctacggttcccggttccccgttccccgtcggtccccgttccccgttcggccccgtaaccggaacgggtccgcccgtaccgggttccgggtaaccgggggcctaacccgggg

SEQ ID NO: 389031 - DNA, 587 bp, Homo sapiens
  misc_feature: GZ8MTXP01EEFMW.44.23.C01.1.454.CMB.2.raw
  modified_base (410)..(410): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctcgtggtactttccatctagttctagtatctattcgttggggctggactccggcgacgccccgagggagggaagtggaggtggtagtggtgactatcctattagtacgtgggcgtacgtacgtacttcctccgtcctacaacgacgtcgtctcacctaattcgaaggacacgtcatcgaaccgtcttacnccctagaactcgacctcgtcgaccgcgcgactacggtcttattcgtgtggcgaggcgtagtcgtgttcttcgtaaatcgtagtcggggtccgtcggtaacctccgttggtcttacgtcgtccttcgttcgacgtccttaccaaccgaacgggcccttagtcccggttccctccccgg

SEQ ID NO: 389032 - DNA, 574 bp, Homo sapiens
  misc_feature: GZ8MTXP01DCPE4.44.23.C01.1.454.CMB.2.raw
  modified_base (307)..(307): a, c, t, g, unknown or other
  modified_base (474)..(474): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagttccatcagttctgatcattctgggctggatccggcagcccccgagggagggaatgggagtggattggtgacatccattatacgtgggcgacgtactactctccgtccctanaagagtcgtctcacctatttcgagggacacgtcatcgaaccccgtcttctccctagaaactcgaccctccgtcgacccgccgcggactacggtccgtttattctgtgcgaggcgagactggttcttacaatctagtgggccgtggggcaccgtgtcactgcttttcncacgtccttaccaccgacggcccacgttccggtcccttccccgtggcccgcccgttcgacctccgacggaacgccgtaccgttcggtcggggccaaccgg

SEQ ID NO: 389033 - DNA, 809 bp, Homo sapiens
  misc_feature: GZ8MTXP01ESNAL.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgtatctattcgttgggctggatccggcacgccccgagggagggagtggagtggagttggtgacatctattatacgtgggacgacgtactactccgtccgtcctacaagtcgtcgtctacactacgtttacggacggactaccgtacacgtacgtaaccccgtctttacctacccgtaacgtaaacccgtcccgtaacccgttcccggtaccggaaccccgggtccccgggtaacccgggtaacccggttaccggggtttacccgttttttaacgtttccggttcgggttacggaccgggtagggtaaccggtaaacggtttaaaccggtttcgggtttttaccctttaacgtaaacgtttccgggttaacggggttaccgggggggtccccgttacggggggtaccccgttaaccccggtttcgggtaccctacggtttcccggttccttccccgtttacgaccggttccctttaccccgaaccggtaacccgggtaaccctcggtttccccgggttcccctttccccggaggtccccgttcccgttcgcccgtaacggacggccgtccgccggttcgggtcggggccaacccggg

SEQ ID NO: 389034 - DNA, 532 bp, Homo sapiens
  misc_feature: GZ8MTXP01AHMTQ.44.23.C01.1.454.CMB.2.raw
  modified_base (222)..(222): a, c, t, g, unknown or other
  modified_base (242)..(242): a, c, t, g, unknown or other
  modified_base (272)..(272): a, c, t, g, unknown or other
  modified_base (402)..(402): a, c, t, g, unknown or other
  modified_base (447)..(447): a, c, t, g, unknown or other
  modified_base (519)..(519): a, c, t, g, unknown or other
  modified_base (523)..(523): a, c, t, g, unknown or other
  modified_base (526)..(526): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcagggtcgttttcggngctgttgcctggttacaacgaaaagggggnacggcccctaaggtcctcgtctcgtcgtgaaaccagactggaagtagacgtcccgtcaggttcagtcgccagtccgaggtggtcgggcccggagtccactctacaaccattgcgacctgcggctgaagtnttctgctacttattctgtacagcagtatcaatgttcgcccgtttnacgttttggccgtacgggacaagctaggaaatcaaacgactgtggcttgcacatcttgttcttcaatctccnctanctnaataac

SEQ ID NO: 389035 - DNA, 592 bp, Homo sapiens
  misc_feature: GZ8MTXP01EZIXN.44.23.C01.1.454.CMB.2.raw
  modified_base (303)..(303): a, c, t, g, unknown or other
  modified_base (508)..(508): a, c, t, g, unknown or other
  modified_base (569)..(569): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgattcattcgttggggctggatccggcacgcccccgagggagggagtggagtggattggngacatccattatacgtggggcgacgtactactcctccgtccctcaacgacgtcgtctcaccctaacgtttcgaagggtactacgtccatacgaacccgtcttcctccctagaaactcgacctccgtgacccgcgcgacacggtcctttattcgtgtcggcgtaggcgacgtcgttggtctttacgaattcgtagtcggggtccgnggtcctaccgttggtccttacgttcgtccttccgttcacgtccttccaaccgcggtacccncgttcccggttccctttccccgg

SEQ ID NO: 389036 - DNA, 571 bp, Homo sapiens
  misc_feature: GZ8MTXP01C6F64.44.23.C01.1.454.CMB.2.raw
  modified_base (349)..(349): a, c, t, g, unknown or other
  modified_base (369)..(369): a, c, t, g, unknown or other
  modified_base (433)..(433): a, c, t, g, unknown or other
  modified_base (443)..(443): a, c, t, g, unknown or other
  modified_base (454)..(454): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgcccccgagggagggaatggagtggattggtgacatccattatacgtggggcgtacgtactactctccgtcctcaacgngtcgtctcacctaatttcgngggacacgtccacgtcgaaccgtcttcctccctagaaactcgacctccgtcgaccgccgcgacnccggtctttnttctgtggcgnggcgagctggtcttacatctagtcggggccgtggcctacccgttggtcacgttcgtccttccgttcacgtccttaccgaaccgacgggccccttagttcccggttcccttcccccgg

SEQ ID NO: 389037 - DNA, 625 bp, Homo sapiens
  misc_feature: GZ8MTXP01EPXDA.44.23.C01.1.454.CMB.2.raw
  modified_base (214)..(214): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatnattcttggggctggatccggcacgcccccgaggggaggggaatgggagtggagttggtgacatccattatacgtgggcgtacgtactactcctccgtccctacaagtacgtccgtctcaccagtttacgagggtacacgtccaagttacgaacccccgtcttctccctagaaacctcgaccctccgtcgacccgccgacggaccacgggtccgtttattctgtgcgtagcgagtacgtggttacttcgaatcgtagtcggggccgtcgggggcctaccgttcggtctacgtcgtctcctcgacgtccttaccaccgaacgggccctacgttccggtcccttccccgtcggcccgttccccgttcgccgtccgacggaacgcccgaccgttccgtaaccgggggcaaccggg

SEQ ID NO: 389038 - DNA, 627 bp, Homo sapiens
  misc_feature: GZ8MTXP01A439O.44.23.C01.1.454.CMB.2.raw
  modified_base (446)..(446): a, c, t, g, unknown or other
  modified_base (521)..(521): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgattctatttcgttggggctggactccggcacgccccgaggggagggatgggagtggagttggtagacatccaattagtacggtgggacgtacgtacttactctcccgtcctacgaagtacgtccgtactcacctagtttacggacggtacaccgttacatacgaacccccgtcttactaccctagaaacctcgacccgtccgcgacccgccgcgacgtacggtctttactctgngcgacggcgagtacgttgttcttacagttctaggtacgggtccggtcgggctcccgtgtcctacgtcgtctctcncgtccttcgaccgaccggcctacgttcccgttcccttccccgtcggcccgttcccgttcgcccttaacccgcggtccgtcgaccgttccggtcggggccaaccggg

SEQ ID NO: 389039 - DNA, 598 bp, Homo sapiens
  misc_feature: GZ8MTXP01BHCIW.44.23.C01.1.454.CMB.2.raw
  modified_base (439)..(439): a, c, t, g, unknown or other
  modified_base (500)..(500): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggaatgggagtggattggtgactatccattagtacgtggggcgacgtactactctcccgtccctcaagacgtcgtctcaccgtatttcgaggacacgtccatcgaaccccgcttctcctagaactcgacctcgtcgacccgccgcgactcggtctttattctgtcgcgacggcgagtacgtggttcttanaacgtcgtagtcgggggccgtggggctaccgtcggtcactcgtctcctcgcgtccttaccnccgtaacgggccctacgttccggttccttccccgtggtcccgttcccgttcgttcctccgtaacggcgtcccgaccgttcggtcgggggccaaccggg

SEQ ID NO: 389040 - DNA, 623 bp, Homo sapiens
  misc_feature: GZ8MTXP01ASQA2.44.23.C01.1.454.CMB.2.raw
  modified_base (499)..(499): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggactccggcacgccccgaggggagggaagtgggagtggagttggtgacatcctattatacgtgggcgtacgtactactctcccgtccctacgaagtacgtcgtctccactacgtttacggacggacaccgtcacgtacgaaccccgcttctccctagaaactcgacctccgcgacccgccgacgacgacggtctttatctagtggcgaggcgagtacgttggttcttgaatcgtaggtcggggacccgttggggccctacccgttggtaccncgttcgtcctacccgtctaacggtccttaccgaccgaaccggtcccctagttcccggtcccttccccgtgcccttcccgttgcccgtcgacggctcccgacgttccgggtcgggccaacccggg

SEQ ID NO: 389041 - DNA, 589 bp, Homo sapiens
  misc_feature: GZ8MTXP01C8GGG.44.23.C01.1.454.CMB.2.raw
  modified_base (464)..(464): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatctagttctgtatctattcgtgggctggatccggcacgccccgagggagggaagtggagtggtagttggtgactatcctattagtacgtgggacgtacgtactactctccgtcctactaacgcgtcgtctacacctaagttcgaacggacacgtacacgtacgaaccgtctcctcctagaaactcgacctccgtcgacccgccgacgtactacgtcctttattcgtcgnggcggaggcgacgtactcggttctttactacttcgtaggtcggggcctgggcctaccgttggtcacgtcgtcttccttcgacgtctaccgaaccgtacgggcccacgttccgttcccttccccgg

SEQ ID NO: 389042 - DNA, 657 bp, Homo sapiens
  misc_feature: GZ8MTXP01EIBFU.44.23.C01.1.454.CMB.2.raw
  modified_base (224)..(224): a, c, t, g, unknown or other
  modified_base (246)..(246): a, c, t, g, unknown or other
  modified_base (519)..(519): a, c, t, g, unknown or other
  modified_base (633)..(633): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgttcttcttctgttggaggcagcgtcaccatcacgttggccgggnagtcgtagggttcgttttcggngtcttgttcgtccgttggtttacgaaaacggtaaaagggggacgacggacccctaaggtcctcgtctctacgtacgaaaccgagacgtagggaacggtagacgtcccgtcgaggtttcaaggttcgaccgtagtccgagggtgggtcgggccccggacgtccacgtctaccgaacctagtcgcgtaccgtggccgtccgtagaagttacttcgtgtaccttaacgttatttctgtacgagtactagtatcaagtacgttcccgtcccggtttnttaacggtttcggaccggtaacgggaccaagtcgaaaggtaactaaccgaaacgtactggtcgtcttagaccttactagttcttcgttccttacgtaacttcccgttaaccccnctacttacttaacgttaattaacg

SEQ ID NO: 389043 - DNA, 588 bp, Homo sapiens
  misc_feature: GZ8MTXP01A12GW.44.23.C01.1.454.CMB.2.raw
  modified_base (242)..(242): a, c, t, g, unknown or other
  modified_base (271)..(271): a, c, t, g, unknown or other
  modified_base (305)..(305): a, c, t, g, unknown or other
  modified_base (416)..(416): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggttacaacgaaaaggggnaggcccctaaggtcctcgtctctcgtcgaaaccngacgtggaaggtagcgtcccgtcaggttcagtgccagtccgagggtggtgggccccggagtccactctcaaccattcgcaccgtgccgctagagtattctgactaactttnttctgtacagctagtatcatacgtccgtcccgttcgtacgttttcgggaccgtacggggaccacggcgtaacgggaaactaccaaaacggacgttgggtaacggtcttaggccttaccgtattccgttagttccttacaacttcctcccgcctattccgtaagttaacttaa

SEQ ID NO: 389044 - DNA, 866 bp, Homo sapiens
  misc_feature: GZ8MTXP01COOGV.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgatctatttcgttggggctggactccggcacgccccgaggggaggggaatgggaggtggagttggtacgacgatcctattacgtacgtggggcgacgtacctactcctccgtccctacgaacgtcgtccgtctacacctagttcgacgggactaccgtcactcgaacccccgtccttactcccgtagaaaccgtacgtaacccgtcccgtacggaccccggacccgggtaccggtaacccgtaccgggttacccgttttaacgtttccgtacgggtacggaccgggtacgggtaccggtaacggttaaccggtttcggggtttaccctttaacgtaaacgttccgggttaacgggttcccggggggtacccggtttccggggggtaccccgttaaccccgggttcggggtaaccctacccggtttccggtcccctttcccgttaacccgtaccgtaccccgtttaaccccggaaaccccggtaaaccggggtcccccttaaccgggttcccccggggtttccccttacccccccgggtcgggtccccccggttccccggttaccggcccccggttaacccggaaaccggggtcccgttccccggaaaccccgggtttcgggggtaaccccggggggttaaccctaaccccggggg

SEQ ID NO: 389045 - DNA, 649 bp, Homo sapiens
  misc_feature: GZ8MTXP01APCTD.44.23.C01.1.454.CMB.2.raw
  modified_base (254)..(254): a, c, t, g, unknown or other
  modified_base (311)..(311): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggtccttcgggaaccctgtcctctcatcgtgctactgttctcgtggtacttccatctagttctgtatntattcgttgggctggactccggcaccggcccgagggagggagtggtgtggtgttggngactatacctattacgtacgggtgggacgtaacgtactactcctcccgtacctacgtaaccgtcgtcgtctaccgacctaacgtttacggaacggacctacgtccacgtaccggtaacctcttccctaccgtacgaaacgtcccgaaccgtccgtacggaccccggtcggacgtaccgtaccggttccgtttattcgtgtcccggggaggtaggtcgacgtaagttccggttactttacgtaacgtgtaacgggtccggtccgtcgcccgtacgttcggtccttcgtcgtcttcgcttcgtcctacgaacgtccgacttcgtccgttccctaacccgg

SEQ ID NO: 389046 - DNA, 650 bp, Homo sapiens
  misc_feature: GZ8MTXP01BDP80.44.23.C01.1.454.CMB.2.raw
  modified_base (572)..(572): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggatggagtggatggtgacatcattatacgtggggcacgtactactctccgtcctcaagtcgtcgtactcacctactttcggagggtacacgtccagtacgaaccccgtcttactccctagaaactcgaccctccgtagacccgccgaccggacgtacggtcttttattcgtgtggcgaggcgagtacgttggttactttcgaagttcgtaggtcggggtccgtcgggggacctaccgtgggtacctacgtcgtccttcctacgcgtcccttaccgaccgtaacggggcccctaacggttcccggttcccctttcccccggnggtccccgttccccgttgccccttaaccggcgggtaacgcccgtacccgttcggggtcgggggaaccctaacccgggg

SEQ ID NO: 389047 - DNA, 657 bp, Homo sapiens
  misc_feature: GZ8MTXP01C7VEC.44.23.C01.1.454.CMB.2.raw
  modified_base (316)..(316): a, c, t, g, unknown or other
  modified_base (614)..(614): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatctattcgttggggctggactccggcacgccccgagggagggaatggagtggattggtgacatccattatacgtgggcgacgtactactctccgtccctacaagngtcgtctcacgtatttcgaggacacgtccatcgaacccccgtcttcctcctacgaaactcgaccctccgtcgacccgccggcggacaccggtcgtttattctgtgcggaggcgagacgttggttctttacgaatcgtaggtacggggcccggtggggtcccgtacccgttgtacctacgttcgtccttccgtaaacgtccttacccgaacccgaacggtccccgtaacgttccccggttacccgtttccccccgttcgggtccccgtccccgttacggcccgttaccgaacgggaccnccgtacccgtccgggttcgggggtaacccaacggaacccgggg

SEQ ID NO: 389048 - DNA, 589 bp, Homo sapiens
  misc_feature: GZ8MTXP01EZB9X.44.23.C01.1.454.CMB.2.raw
  modified_base (271)..(271): a, c, t, g, unknown or other
  modified_base (308)..(308): a, c, t, g, unknown or other
  modified_base (427)..(427): a, c, t, g, unknown or other
  modified_base (448)..(448): a, c, t, g, unknown or other
  modified_base (489)..(489): a, c, t, g, unknown or other
  modified_base (542)..(542): a, c, t, g, unknown or other
  modified_base (554)..(554): a, c, t, g, unknown or other
  modified_base (563)..(563): a, c, t, g, unknown or other
  modified_base (586)..(586): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgtatctattcgttgggctggatccggcacgccccgagggagggatggagtggatggtganatcattatacgtgggcacgtactactcctccgcctanagacgtcgtctcactactttcggacggactacgtcatcgtaacccccgtcttcctacccgtagaaacctcgaccctccgtcgacccgccggcggaccgtcgtcgtttattcgtgtgcgnggcgagtacgtggttccttanagttcgtacggtcggggccgttcggaccgtccgtggtaccnttcgtcctcgctacgtcctccgaccgacggcctacgttccggtcccttcccgnggccttacccgnttacccgcngggctcgccgttggtcgggaacncgg

SEQ ID NO: 389049 - DNA, 656 bp, Homo sapiens
  misc_feature: GZ8MTXP01DL9Z0.44.23.C01.1.454.CMB.2.raw
  modified_base (609)..(609): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggactccggcacgccccgaggggagggaagtggagtggattggtgacatctattagtacgtgggcgtacgtactactctccgtcctacaacgtagtcgtactcacctagtttcggacgggtacacgtccatcgtaaccccgtcttacctccctagaaacctcgtaccctccgtacgacccgtcccggaccggaccgtacgggtccgttttacgtttcgtcggtcggacggacggcgtacggtacgttcggttctttacaacgttcgtaggtcggggtcccgtggggcccgtacccggttgtccgtactccgttcctcccgtactacgtcccttacccacccgaacgggtcccctattcccggttccccttccccgtcggtcccncccgttcgccgtccgacggccgacgccgttcggtcggggcaaccggg

SEQ ID NO: 389050 - DNA, 635 bp, Homo sapiens
  misc_feature: GZ8MTXP01E5I1Y.44.23.C01.1.454.CMB.2.raw
  modified_base (272)..(272): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttgaggcagcgtcaccatcacttgccgggcgagtcaggtcgttttcggtgctgttgcctggtttacaaacgaaaagggggnacggcccctaaggtccctcgtctcgtcgtagaaaccagacgtgggaagtagacgtcccgtcaggttcagtgccagtccgaggtggtcgggccccggagtccactctcaacctattcgccgacctggccggcctagaaacgtattctgactaactttattctgtcagcagtatcagtacgtcgtccccggtttctacgttttcgggacccgtaagggggaacccaaggtacgtagggtaaaactaccgaaaacgtaaaccgtggtaacggtccgttcggaccttaccctacgttccttacggttccctttaccgtaacttccccgttaaccccggtccctaacgttccttaagaacttttaacg

SEQ ID NO: 389051 - DNA, 758 bp, Homo sapiens
  misc_feature: GZ8MTXP01ADZL4.44.23.C01.1.454.CMB.2.raw
  modified_base (272)..(272): a, c, t, g, unknown or other
  modified_base (277)..(277): a, c, t, g, unknown or other
  modified_base (313)..(313): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgccccgaggggaggggatgggagtggattggngacancatagtacgtgggacacgtactactctccgtcctanaagacgtcgtctcacgtagtttcggacgggactacgtccatccgtaacccgccttctacccgtacgaaaccgtcgtaccctccgcgacccgccggaccggaccgtcggtccgtttattccgtgtcgacggacggacggtacggtaacgttgggttacctttacgaacgttcgtaacggttcgggggtaccggttcgggggaccctaaccccggttcgggtaccctacggttcgttcccgttacccgttacctaaccggttcccttaccccgaaacccggtaacccgggggttcccctaacgggtttccccgggttacccccgtttcccccgggttcccgggtacccccgttccccggtttccggccccgtttaaccccgggaaacgggttccccggacccggttaccccgttaccgggggttccgggggaacccgaaccccgggg

SEQ ID NO: 389052 - DNA, 694 bp, Homo sapiens
  misc_feature: GZ8MTXP01B4Z7A.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgattctattcgttggggtctggactccggacacggccccgaggggaacgggagtgggagtggagttggtagacatctattatacgtggggcacgtactactcctccgtcctgaacgtacgtcgtctacctaccctaagtttacggaacggacctacggtccacgtcgaacccgtcttaccctacccgtagaaaccgtcgtaccctcccggtacgtaccccggcccgtacggtaccgtaccgggttaccgtttacgtttacgtcggtacgggggtaccggtaggggtaccgtacggttaccgttcgggtttacctttcgaaacgtttcgtaacgggtcgggggtccgtacgggccctaacccgttgggtacccttcgttcggtccttcccgttcgacgtccctacccgaaccgtaacgggcccttacggtcccgtttcccttcccccggg

SEQ ID NO: 389053 - DNA, 601 bp, Homo sapiens
  misc_feature: GZ8MTXP01CPL1S.44.23.C01.1.454.CMB.2.raw
  modified_base (375)..(375): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggactccggcacggcccccgaggggacggggaagtggaggtggtagttggtggaactacgtcctaatttagtacgtgggggaccgtaacgtacctactcctccgtccctcgaaaccgngtcgtctcacctaagtttcgaaggacaccgtcatcgaacgtcttctccctagaaactcgacctccgtcgacccgccgacggaccacggtcctttattcgtagttggcggaggcgagtactagtctttcaaatcgttacggtcggggtccgtcggccgtaccgttgtcgacttcgtcttccgttcacgtcctaccaaccgacggtcccacgtccgttccgttccccg

SEQ ID NO: 389054 - DNA, 662 bp, Homo sapiens
  misc_feature: GZ8MTXP01ADG59.44.23.C01.1.454.CMB.2.raw
  modified_base (268)..(268): a, c, t, g, unknown or other
  modified_base (538)..(538): a, c, t, g, unknown or other
  modified_base (643)..(643): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttgggctggatccggcacgccccgaggggagggaatgggagtggattggngacatccattatacgtgggcgacgtactacttctcccgtcctacaagcgtcgtactaccacgttacgtcggaacgtactacgtacgtagtaccgaccccgttcttcctaccgtaaactacgtaccgtacccgttcgcccgacccggtccggaccggtacggtaccggtttaccgtttttacgtcgttggacggtacgggacggtacgtaggttaccgttggtttacctaagtacgttacgtcggggtccggtcgcggtacctccgggttntaccgtgtccgtacctcgactcgtcctaccgacgtacccggcttcggttccttccccgccggtacggtccccttcgacgttccccgaacgagccgtcctccgggngggtccgaaccgtcccggg

SEQ ID NO: 389055 - DNA, 584 bp, Homo sapiens
  misc_feature: GZ8MTXP01ELNAO.44.23.C01.1.454.CMB.2.raw
  modified_base (506)..(506): a, c, t, g, unknown or other
  modified_base (543)..(543): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttggggctggactccggcacggccccgaggggaggggaatgggagtggattggtgacatccattatacgtgggcgacgtactactctccgtcctcaagacgtcgtctacactagtttcgagggacacgtcatcgaaccccgcttctccctagaaactcgaccctcgtgacccgcgcgacacggtctttattctgtgcgaggcgagtacgttggttctttcgaattcgtaggtcggggccgttcgggaccgtaccgtggtccacttcgtcctcctcacgtccttccacncgtcgggcccttagtccgttccgtccccgtgggcccnccttagccctcgaacggtccgcgaccgttcggcggggaacc

SEQ ID NO: 389056 - DNA, 679 bp, Homo sapiens
  misc_feature: GZ8MTXP01AVQ5J.44.23.C01.1.454.CMB.2.raw
  modified_base (271)..(271): a, c, t, g, unknown or other
  modified_base (650)..(650): a, c, t, g, unknown or other
  modified_base (674)..(674): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttgggctggatccggcacgccccgaggggagggagtggagtggagttggnacatctaattagtacgtgggacgtacgtactactcctcccgtcctacaagacgtctctacaccgtagtttacggacggtacacgtcagtcgaaccccgtccttctaccctagtaaacctccgaacccgtccgtacggaccccgccgggtaccgaccgtaccgggttccgttttacttccgtaggtcggacggtacgggcgtaggtacgttcggttactttcgaagttcgtaaggtcggggtccgtcgggggaccttcccggtaggtccttcgttccgtccttcccgtacgacgtcccttacccgaaccggtacggggtcccctacgttcccgggttccccttccccggcggtcccgcccttgccccgtcgcggaacccncctacggttccggtggggaacccnccggg

SEQ ID NO: 389057 - DNA, 680 bp, Homo sapiens
  misc_feature: GZ8MTXP01DOF9L.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggccaggactggtgaggccttcgggaacctgtctctcatctgcactgtctctggtacgtttccatcagttctgatctatttcgttggggctggactccggcacggccccgaggggagggaagtgggagtggagttggtagacatcctattagtacgtaggggcgtaacgttactactcctcccgtccctacaagacgtcgtctaccacctacgtttacggacgggtacaccgtccatacgaaccccgtccttctccctagtaaacctcgaaccctcgtcgacccgccgcgacaccggtctttattctgcgcggaggcgagtacgtcggttacttacaacgttcgtaggcggggtccgtcggggcctacccggttggtacctacgttccgtcctccgtaccgtacgtcccgttacccaccggtaacgggtcccctaacggttcccggttcccccgtttccccggtcgggtccccgttcccgttcgacccgttcccgaacgggtccgtcccgtacccggttcgggtccgggggaaccccgccgg

SEQ ID NO: 389058 - DNA, 731 bp, Homo sapiens
  misc_feature: GZ8MTXP01AEGPZ.44.23.C01.1.454.CMB.2.raw
  modified_base (220)..(220): a, c, t, g, unknown or other
  modified_base (239)..(239): a, c, t, g, unknown or other
  modified_base (277)..(277): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcacatcacttgccgggnagtcaggttcgttttcggngtctggttcgccgttggttacaaaacggaaaagggggngacggaccccgtaaggtcctcgtctcgtacgtagaaaccgagacgtagggaaacggtacgaccgtccccggtacgtagggtttacagttcgaccgtaggttccgaggggtcgggtacggggcccccgtacgtccgactcgtaccaaaccgtagttaaccggccggtaaccgtgggacccgggtccgtaaggaaacgttacttacgttacgtaaccttaaacttttacgtttctacgttacgacgtacgtaagttaactacgtaacgttacgttcccggttacccccgggtttacttaccggtttttaccgggaacccggtaacgggggttaacccaaggtacgttaaacgggaaaacttaccgaaaaccgtcgtagggtcggtacgttcgaccttaccgtacttcttacgttccttcaacttccgtccctctacttcctaagttaactttaacg

SEQ ID NO: 389059 - DNA, 771 bp, Homo sapiens
  misc_feature: GZ8MTXP01AK0YT.44.23.C01.1.454.CMB.2.raw
  modified_base (273)..(273): a, c, t, g, unknown or other
tcagacagtatatacacgaccggtgctcgatttagtacacgtgattagggattggggcagggtgaacacctgttggtttttcctcctgctggtggcagctcccagatgggtcctgtcccaggtgcagctgcaggagtcgggcccaggactggtgaggccttcgggaaccctgtctctcatctgcactgtctctggtacgtttccatcagttctgatctatttcgttggggctggactccggcacgccccgaggggaggggaagtgggagtggngtggtagacatcctattagtacgtgggacgtacgtactaccttcctcccgtccctacgaacgtacgttcgtcctacctacctagtttacggaacgggacctaccgtaccaagtaccgtaacccccgtccttacctacccgtacgaaacccttccgaccccgtcccggtaccggaaccccgggcccggaccgggtaccgtaccgggttccgttttactttcgtggtcggacggtagggtccggaaggtacgttcgggtttacctttacgtaaacgttccgttaacgggtccgggggtacccgttcggggggtaccctacccgttggtacctaccgttcgttccctccgtaccgtcgtccccttacccgaacccggtaaccgggcccctaacggttccccggttccccgttcccccgtcgggtccccgttccccgttccgttacccgtcccggacgggtaacccgccgtacccggttcgggtcggggaacccgtaaccgg

SEQ ID NO: 389060 - DNA, 224 bp, Homo sapiens
  misc_feature: GZ8MTXP01EVSWH.44.23.C01.1.454.CMB.2.raw
  modified_base (224)..(224): a, c, t, g, unknown or other
tcagacagtatatacacgaccggtgctcgatttagtacacgtgattagggattgggggagtcagaccctgtcagggacagcatggacatgagggtcccgctcagctcctgggctcctgctgctctggctcccaggttcgagatgtgacatcgagatgacccagtctccttccttcctgtcttcttctgttggaggcagcgtcaccatcacttgccggcgagtcn

SEQ ID NO: 389061 - DNA, 632 bp, Homo sapiens
  misc_feature: GZ8MTXP01CJUBE.44.23.C01.1.454.CMB.2.raw
  modified_base (543)..(543): a, c, t, g, unknown or other
  modified_base (627)..(627): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatctattcgttggggctggactccggcacgcccccgaggggaggggaagtgggaggtggagttgggtgactatcctagttagtacgtggggcgacgtacgtacctccgtcccgtccctacgaagacgttcgtctctacctatttcggaggacacgtccatcgaacccccgtcttactccctagaaccctcgaccctccggtcgacccggcccggcggaccgtacgggttccgtttatttcgtgtggccggaggcgagtacgttcgggttcctttacgattcgtacggtcggggtaccgtcggggcctacccgtcggtctactgtccttcctcnctccttccaccgacggcccctagttcccggttccttccccgtgccgcccgttgccgtcacggcgcctccgttcggcggggttcnccggg

SEQ ID NO: 389062 - DNA, 592 bp, Homo sapiens
  misc_feature: GZ8MTXP01DXRGA.44.23.C01.1.454.CMB.2.raw
  modified_base (240)..(240): a, c, t, g, unknown or other
  modified_base (274)..(274): a, c, t, g, unknown or other
  modified_base (310)..(310): a, c, t, g, unknown or other
  modified_base (455)..(455): a, c, t, g, unknown or other
  modified_base (548)..(548): a, c, t, g, unknown or other
  modified_base (561)..(561): a, c, t, g, unknown or other
tcagacagtatatacacgaccggtgctcgatttagtacacgtgattagggattggggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcagtcaggttcgtttcggngctggttgcctggtttacaaacgaaaaagggggngacggcccctaaggtcctcgtctctcgtagaaaccngacgtagggaagtagacgtcccgtcgaggttcagtgccagtccgagggtggtcggggcccgacgtccgactctacaacccaattcgccgtacgtcgcggcctagaaagtacttctgtactaatttattctggtacagctaagtanactagtacgtccgtcccggttacttacgtttcgggaccgtaaggggaccaagtcgtaaaggaactaacaaaagacgtgtggcttcgcaaactntcttcgttccttntaaccgttacttcccatattatgttaattaa

SEQ ID NO: 389063 - DNA, 578 bp, Homo sapiens
  misc_feature: GZ8MTXP01A26JD.44.23.C01.1.454.CMB.2.raw
  modified_base (272)..(272): a, c, t, g, unknown or other
  modified_base (536)..(536): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggaggggaatggagtggattggtgacanccattatacgtgggcgacgtacgtactcctccgtccctcgaagacgtcgtctcacctatttcggaggacacgtcatcgaaccccgcttcgtccctagaaacctcgaaccctccgtacgacccgcccggccggactaccgggtcgtttattcctgtgcgaggcgagtactggtcttcaagttctagtgggcgtcggggcacccgtgtcactcgtcctctcagccttccacacggaacccagttccggtccttccccgtcgggccncccgttcgctccaggaacgcgaccgttcgtcggggcaaccgg

SEQ ID NO: 389064 - DNA, 717 bp, Homo sapiens
  misc_feature: GZ8MTXP01CVFHO.44.23.C01.1.454.CMB.2.raw
  modified_base (345)..(345): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgttcttcttctggttggaggcagcgtacactatcgtacgttcggccgggcgtagttcgtagggttcgtttttcgggctcgttggttcgtccgttacggtttacgaaacggaaaagggggtcgaacggtcccctaaacggtcctcgtctcgtacgtacgaaacnggacgtaggggaaggtacgacggttacccgtcgtacgggttcacggttcgaccgtacggtccgtagggggtcgggtcggggaccccggtactccgacgttacctaccgaaaccgttattaacggctaccggtcggccggtaccttaggaaacgttcttacgtcgttaaccttaacgtttactttcgtgtacgtacgtactagttactcgtaactcgttacccgttcccggggttacgtaccggttttcggaccgggtaacggaacaacggtacgtaacgtaaactaccgaaacgcgttcggtggtcacggtccttaacgtctcttcgttccttctaaccttcccgttccacttcttactcgttaactttaag

SEQ ID NO: 389065 - DNA, 485 bp, Homo sapiens
  misc_feature: GZ8MTXP01EU64L.44.23.C01.1.454.CMB.2.raw
  modified_base (285)..(285): a, c, t, g, unknown or other
  modified_base (339)..(339): a, c, t, g, unknown or other
  modified_base (463)..(463): a, c, t, g, unknown or other
  modified_base (470)..(485): a, c, t, g, unknown or other
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagacggccctggtaccaggcgagtggtacctctactactactctcgtggacgtcgtgggggcccaggggaccgcggtcaccgtctccncagcctccaccaaggcccatcgtcctcccccgtggccacccctcctccaagacnccaccctcgtcgggggcacgacggccggcccgtcgggctcgccgtggtaccgtaaaacgggacctttaaccttacctatactttacgtgtccgtgggacggcgggcgtcgggacgaagggccgnacgtagnnnnnnnnnnnnnnnn

SEQ ID NO: 389066 - DNA, 699 bp, Homo sapiens
  misc_feature: GZ8MTXP01EF4HX.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaccctgtctctcatctgcactgtctctggtagttccatcagttctgatctattcgttggggctggactccggcacggccccgaggggagggatgggagtggagttggtgactatacctaagttacgtacgtggggaccgtaacgttacctacctccgtcccgtcccgtacaagtcgtccgtactacctacgtacgtttacggacggactacgtccagtacgaccccgtccttactccctagtaaacctcgaccctcgtcgacccgccggccgacgtaccggtcttttacttcgtggtcgcgaggcgagttacgttcggttacttacgaagttccgtaggtcggggtaccgttcggggccttaccggttgtaccgtacgttcgtccttcctacgtactccgttacccgaccgaacgggtcccctaacgttcccgggttccccctttccccggcgggtccccgttcccgttcggaccccgttccggaacggcccgtccccgtaccggttcggggtccgggggaaccctaacccgggg

SEQ ID NO: 389067 - DNA, 799 bp, Homo sapiens
  misc_feature: GZ8MTXP01BYBTK.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtacgttcatcagttctgatctattcgttgggctggactccggcgacgccccgaggggagggaatgggagtggtagttggtgactatcctattagtacgtggggcgtacgtacctacgtccgtcccgtccctacgaagtcgtcgtctccactaagtttccggaacgggtaccacgtaccgtaacgtcgtaaccccgtcctttacctccctaagaaacccgttcgaacccttccggtacgaccccgggcccggtaccgggtaccgtaccggggttaccgttttacgtttcgttcggttacggacgggtacgggacggtaacgttaccggttaccggtttacctttacggtaacttaccggttacggtacgggggttccccggttcgggggacccgttaccccggttgggtacccttacgtccggttcccttacccgttaccgaccggttcccctttacccggaacccggtaaacccgggggtccccttaacgtttccccgggttccccttccccggtacgggtcccccggttcccgttcggcccgttaacccggaacgggccgttacccgcccggtttccgggccggggggttaacccaacccgggg

SEQ ID NO: 389068 - DNA, 768 bp, Homo sapiens
  misc_feature: GZ8MTXP01BQH3X.44.23.C01.1.454.CMB.2.raw
  modified_base (276)..(276): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctatttcgttggggctggactccggcacgccccgaggggagggaagtggagtggtagttggngactatcctagttagtacgtagggaccgtacgttactacctccgtcccgtaccctacaagtacgttcgtactccgtacctagtttacggacgggtaccaccgtccacgtacgtaacccccgtccgttaccttacccgtagtaaacctccgaaccccgttccggtaccgaccccggacccgggaccggtaaccgttaccggggttccgtttttaacgttccgtaggttcggacgggtacgggacgtacgtacgttcggttactttacgaagttcgtaagggtcggggtaccgtcggggtccctaccgttcgtacgtcgtcgtcccttccgtcgtacgtcccgttacccgaaaccggtacccgggtccctacggtttccccgggttccccctttccccggccgggtcccgttaccccgttcggccccgttaacccgggacggtaaccgtcccggtacccggttccggggtaacgggggaaccctaaccccgggg

SEQ ID NO: 389069 - DNA, 780 bp, Homo sapiens
  misc_feature: GZ8MTXP01A372O.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtatctattcgttggggctggacgtccggcacggccccgagggagggaagtgggagtggagttggtgacatcctattacgtacggtggggacgtaccgttactaccgttccgtcccgttacccctacgtaacggtacgttcggtactacctacccgtagtttacggaacgggtactaccgtaccgaacgttaccggtaaacccccgtcctttaccgtaccccgtaagtaaacccgtacgaaccccgttccggtaccgaccccggcccggtaccggtacccgtaccgggttaccgtttttacttcccgttggtacggcggacggtacgtagtaccgttcgggttacttcgaaactccggttaggtccggggtccgtacggggtccctacccggttgtaccctcgttccggtctcccgtttccgacgtacccgttacccgaaccggtaaccgggtccccttgttccccgggtttcccccttccccgggttccggaaccccgttcccgttacgccccgttccggacgaacggtcccggtacccgttcggtaacgggggccctaacccgggg

SEQ ID NO: 389070 - DNA, 621 bp, Homo sapiens
  misc_feature: GZ8MTXP01CINBT.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatgggagtggattggtgacgatcccgtaattatacgtggggacgacgtactactcctccgtccctcaagcgtcgtctcaccatttcgagggacacgtaccatcgaaacccccgtcttctccctagaaactcgaaccctccgtgacccgccgtcgacacggtctttattctgtgcgagtcgagtactgttcttcgaatctagtcgggccgtggggccaccgtggtacactgtcctcctacgacgtccttcccgaaccgtaaacgggcccctaacgttcccgggttcccttcccccgttcgggcccgttccccttcgggttccctcccggaacggtaacgcccgtacccgttacccggtaaggaaccgaacccg

SEQ ID NO: 389071 - DNA, 639 bp, Homo sapiens
  misc_feature: GZ8MTXP01A62J2.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatcagttctgtattctattcgttgggctggatccggcacgccccgagggagggagtggagtggagttggtgactatcctattagtacggtggggacgtacgtactacttccgtccgtccctacgaacgtacgtcgtctccacctaacgtttcggaacgggtacaccgtccacttcgaaccgtctttacctccctagtaaacctcgaacccgtcggtcgacccgccgcggaactccgggtctttattctggtcggcggaggtcgacgtacgttcggttctttacgaacgttcgttaaggtcgggggtaccgtcggtccctacccggttggtcccttacgtcgttccttccgttcacggtccttcccgaacgtaccggccttacgttccggttcccttcccccgg

SEQ ID NO: 389072 - DNA, 637 bp, Homo sapiens
  misc_feature: GZ8MTXP01DG5MJ.44.23.C01.1.454.CMB.2.raw
  modified_base (386)..(386): a, c, t, g, unknown or other
  modified_base (610)..(610): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagttccatcagttctgatcattcttggggctggatccggcacgccccgaggggaggggaagtgggagtggagttggtgacatccattagtacgtggggacgacgttactactcctcccgtccctacaagtacgtcgtctcacctagtttacggagggaccacgtacatacgaaccccgtctactcccgtanaaacctcgaaccctccgtcgacccgccggacggaccgtacggtcgtttacttcgtgtcgcggtaggcgtaagtacgttcgttctttacgaagtctaggtcggggtcccgtggggtcctaccgtggtctacgttcgtccttcctacgacgtccttacccgacgaacgggtccctacgttccggttcccttcccgtcgcccgttcccgttcgccgttcgacggtcnccgtaccgttggtccgggcgtaaccgg

SEQ ID NO: 389073 - DNA, 711 bp, Homo sapiens
  misc_feature: GZ8MTXP01BMSUN.44.23.C01.1.454.CMB.2.raw
  modified_base (348)..(348): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggtagtttccatctagttctgatctattcgttgggctggatccggcacgcccgagggaggagtggagtggagttggtagactatactattagtacgtgggactacgtactacgtctccgtcctanacgtagtcgtctactacctaacgttcgaacggtacaccgttaccaacgtcgtaacccgtctttacccgtacccttaaggtaaacccttcggaaccccgttcccggtacggaacccccggtccgggtaccggtaaccggtacccgggttaccgttttaactttcggttcggttacgggggcggtaacgggtcggaacggttacgttgggttacctttacgtaaacgttcgttacgggtcggggtcccggtcgggtccctaacccggttcggtaaccttccgtcgttcccttaccgttcgttaccgtcccttacccgaaccggtaaccgggtcccttacggttcccgttccccgtttcccccggg

SEQ ID NO: 389074 - DNA, 782 bp, Homo sapiens
  misc_feature: GZ8MTXP01CITLQ.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggccaggactggtgaggccttcgggaaccctgtctctcatctgcactgtctctggtacgttccatctagttctgatctagttcgttgggctggactccggcacgccccgagggagggagtggagtggtagttggtagactatctattagtacggtacgggacgtaacgtacctacctccgtcccgtaccctacgtaagcgttaccgtctacctaccgttacgtttacggacggtacctaccgtaccagtaccgtaacccccgtccttactacccgtacgtaaacctccgaacccgttccggtacgaccccgtaccggaccggtaccgtaccgggttcgtttaacgttccgtggtcgtacggagggtcgtagtaccgttggttacctttacgaacgttccggttagggtccgggggtacccgttacgggggtccccgttaaccccggtttgggtacccctaacgtttcccgggtaccctttcccgtaccggtacctttccccgtaacccgaaacccggttaccggggccccttacggttcccggttccccttaccccgggtccgtcccgttcccccgttgttaccctcccgggaacgggtccgtccccgtacggttaccgggggtccgggggccctaacccgggg

SEQ ID NO: 389075 - DNA, 633 bp, Homo sapiens
  misc_feature: GZ8MTXP01DBCX0.44.23.C01.1.454.CMB.2.raw
  modified_base (580)..(580): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcatttcgttggggctggatccggcacgccccgagggaggggaagtggaggtggtagtggtgacagtcattagtacgtgggcgacgtactactcctccgtccctcaagacgtcgtctacacctatttcggacggactacgtcatcgaaccccgtctctcctacgaactcgacctcgtcgaccgccgacgacgacgtcgtttacttctgtgcggaggcgacgtacgttcggttccttacgaacttcgtaacggtcggggtaccggttcgggcccgttaccgtcgggtacctacgttcgtccgttcctacgcgtcccttaccgaaccgccgggaaccctcgttcccggttcccttccccgttcgggcccncccgttcgcccttccggaggaaccctcggaccgttcgggtcggggcaaccggg

SEQ ID NO: 389076 - DNA, 832 bp, Homo sapiens
  misc_feature: GZ8MTXP01ERW3B.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactgggtgacggtccttcgggaaccctggtctcgtcatctgctacttgtctcgtggtagtttccatctagttctgtatctattcgtgggctggactcggcacgccccgaggggacggtaagtggaggtggtacgttgggtcgaacgtagttacccgtaagtttaacgttacggtggggggaccgtaaaccggtttaccgttaaccgttcccgttaccccggttacccccgttaccggtaaaccggtaccggtttaccgtacccgttacctaaccccgttaaacggttttacccgggaacgggggtaaccctaaccggtacccctaaagttaacccggtaaaccccggttcctttacccctacccgttaaccgtaaaccgttcccgtaacccgttcccggttacgtaaccccggccggtaccggtaacccggtaccggttaccgtttacttacgtgttacggggcgttacggggacgtacgttacgttcgggttccctttagaacgttcgtaagggtccggggtcccgtcgggtaacccctaacccggttcgggtacccttaacgttccggttccttaacccttcgaccgttccgttacccgaacccgtaaccgggtcccttaccggttccccggtttccccgtttccccccgggg

SEQ ID NO: 389077 - DNA, 860 bp, Homo sapiens
  misc_feature: GZ8MTXP01DLW8D.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggtacgtttccatcagttctgtatctattcgttggggctggactccggcacggaccccggaggggaggggaaagtgggaggtggtagttagggtcgaactactacctaagttacgtacggtagggggaccgtaaccggttaaccttaccgttcccgtaccccgtaccccgtaacgaacggtacgttaccgttacctacccgtaaccgttacgttttaccgggaacgggtaacctacccggttacctacgtaaccgtaaaccccgtcctttaccgtacccgtaaacgtaaacccgtacccgtacccgttcccggtccggtaaccccggcccggtaccggtaacccgtacgggtttacccgttttaacgtttcgttcggtacggtacgggacggtacggtaacggtacgtttcgggtttacctttacgtaacgttacgtaacgggttccgggggtcccggttcgggggtaccccgtaaccggttcgggttaccctacgttccgttacctcccgttacctaccgtcccgttaacccgaacccggtaaccgggtcccctaacggttccccggtttccccgttccccgtcgggtccccgttcccgttcgacccgtaacccgggacggtcccgtcccggtacccggttcgggtaaccgggggccctaacccgggg

SEQ ID NO: 389078 - DNA, 697 bp, Homo sapiens
  misc_feature: GZ8MTXP01D1FDV.44.23.C01.1.454.CMB.2.raw
  modified_base (637)..(637): a, c, t, g, unknown or other
  modified_base (644)..(644): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaacctgtctctcatctgcactgtctctggtagttccatcagttctgatctattcgttgggctggacgtccggcacgccccgagggagggagtggagtggagttggtagactatcctaattagtacggtgggcgtacgtactacctctcccgtcctacaagtcgtccgtctactaccgtacgtttacggaacgggtacctaccggttaccacgttaccgtaacccccgtcctttaccgtacccgtaacgtaaacccgttccgtaaccccttcccggtacgaccccggcccggtaccggacccgtaccgggttccgttttacttcgtggtacggacggtaggacgtagttacgttcggtttacttacgaagttcgtaggtcggggtccgtcggggccctaccggtcgtacctcgtcgtctcctacgcgtcccttaccgaccgaccgtaaccctcgttccccggtcccttccccgnggtcccncccgttcgccgtcccgaggtaaccgccgtaccgttcgggtccgggcgaaccgg

SEQ ID NO: 389079 - DNA, 722 bp, Homo sapiens
  misc_feature: GZ8MTXP01C799V.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggccaggactggtgaggccttcgggaaccctgtctctcatctgcactgtctctggtacgttccatcagttctgatctattcgttgggctggactccggcacgccccgaggggagggaagtgggagtggtagttggtgaacacgtacctaagttacgtacggtgggacgtacgtactactccgtaccgtcctacgaagtcgtcgtactctactacgtttcgacggtacacgtacagtacgaaccccgtctacctaccgtacgaacgtccgtaccctccgtaccgacccggccggaccgaccgtaccggttctttacgttcgtgcgacggtaggacgtacgtacgttcgtttactacgtagttcgtacggtccggggtccgtcggggtaccccgtaaccggttcgtacccgtacgttccgtcctccgtccgtaccgtcccgttaccccgaaccggtaacccggtcccctacggtttccccggttccccttcccccggttcggccccgttccccgttcggttaccccgttaaccggacgggtcccgtcccgtacccggttaccgggtaacggaacccgtaaccccggg

SEQ ID NO: 389080 - DNA, 808 bp, Homo sapiens
  misc_feature: GZ8MTXP01ANCN5.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggactccggcacggccccgaggggaggggatgggagtggtagttggtagactatccaattagtacgtggggacctacgttactacttcctacccgtcccctacgaagtacgttccgtacctcctacccgtagttttaccggaacgggtacccaaccggttacctaacgtaccggtaaaccccccttcctttaccgtaccccgtaaagtaaacccgtccggtaaccccgtccggttaccgggaaacccccggtcccggacccgggtaaccgtaccgggttacccgtttttaaacgtttccgtacggttcggaccgggtacgggtaccgtaacggtaacccgttgggtttaacctttacgaaacgttcgttaacgggtccgggggtccgttcgggggacccttacccggtcggtaccctacgttccgtccgttcctaacgtcccgtccttaaccccgaaccgtaacggggtcccctaaggtttccccggttccccgtttccccgcggtccccggttcccttcgaccccgttaacccggaggtccgccccgttaaccgttccggggttcgggggccaacccgggg

SEQ ID NO: 389081 - DNA, 675 bp, Homo sapiens
  misc_feature: GZ8MTXP01BFYOK.44.23.C01.1.454.CMB.2.raw
  modified_base (223)..(223): a, c, t, g, unknown or other
  modified_base (324)..(324): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttctgtcttcttctgttggaggcagcgtcaccatcacttggccgggngtagtcgtaggttcgttttcggtgtctgttcgtccgtaggtttacgaaacggaaaagggggcacggcccctaaggtccctcgtctcgtacgtacgaaaccngacgtagggaagtcgacgtcccgtcgaggttcagtcgccagtccgagggtcggtcgggccccgtacgtcactctccaacctagttaacgcgtaccgtcggccggtacctaggaacgtacttcgtagtacttaactttatttccgtgttacacgtctaagtactacagttacgttcccgtaccccgtttagtaccggtttcgggacccggtaacgggaaccaggtaccgtaaaggaaactaccgtaaaacgtacgttggtaaccggtcttcggtaaccacgttaattcccgttacgttccttacctaaccttcccgttaacccgacttacgttcgttaacgttaattaaccg

SEQ ID NO: 389082 - DNA, 626 bp, Homo sapiens
  misc_feature: GZ8MTXP01DKD3W.44.23.C01.1.454.CMB.2.raw
  modified_base (273)..(273): a, c, t, g, unknown or other
  modified_base (310)..(310): a, c, t, g, unknown or other
tcagacagtatatacacgaccggtgctcgatttagtacacgtgattagggattggggggagtcagaccctgtcaggggacagcatggacatgagggtccccgctcagctcctggggctcctgctgctctggctcccaggttcgagatgtgacatcgagatgacccagtctccttccttcctgtcttctctgttggaggcagcgtcacatcacttggccgggcgagtcaggttcgttttcggtgctgttgcctggttacaaacgaaaagggggnacggcccctaaggtccctcgtctcgtcgtagaaaccngacgtagggaagtagacgtcccgtcgaggttcagtgccagtccgagggtggcgggcccgagtcactctcaacctattaacgcgaccgtggcggcctagaagtattctgtacttaactttatttctgtacagctaagtactctaatacgtccgtccccggtttctaaccggttttcgggaccgtaagggggaacccaaggtaccgtaaagggaaactacgaaaacgtacgttggtaacggcttaggaccaacccgtattccgttacgttcttcctaacttcccgttaaccccgtcctagttcctaagttaatttaac

SEQ ID NO: 389083 - DNA, 717 bp, Homo sapiens
  misc_feature: GZ8MTXP01DYP7Q.44.23.C01.1.454.CMB.2.raw
  modified_base (275)..(275): a, c, t, g, unknown or other
  modified_base (646)..(646): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagttccatctagttctgatctattcgttgggctggactccggcacgccccggaggggagggaagtggagtggtagttggngactatacctattatacgtgggacgtacgtactactcctcccgtccctacaagtacgtcgtctaccacctacgtttacggacggtacctaccgtaccacgtacgaaccccgtccttaccgtcccgtagaaacccgttccgaacccgttccggtaccggaccccggtacccggaccgggtaaccgtaccgggttccgttttacttccgttggtcggcggacggcgtaacgttacgttcggttacttacgtaacttcgtaacggtcggggtaccgtcgggccctacccgtggtcctacgtcgtcctccgtaccgtacgtccttacccgaccgtaaaccgggtccctacgttccccgggtccctttcccccggnggtcccgttccccgttcgacccttcccggaggaacctccgtacccgttcgggtccggggccgtaacccggg

SEQ ID NO: 389084 - DNA, 659 bp, Homo sapiens
  misc_feature: GZ8MTXP01A0QVW.44.23.C01.1.454.CMB.2.raw
  modified_base (304)..(304): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttggggctggactcggcacgccccgagggagggagtggaggtggagttggngactatcctattatacgtgggggactacgtactactctccgtacctcgaacgtacgtcgtctacacctaattcgaaggacacgtaccatcgacgtctcctcctagaaactcgaccctccgacgacccgcgcggtaccgaccggttcgtttacgttcgtaggcggggacggacggtacgacggtaccgtttcgggttcctttactaaacgttcggttacgggtccgggggtcccgttggggtcccctaaccgggtttgggtcccttacgttcgggtcccttcccgttcgttaaccgttccgttacccaaccggtaaccgggcccttaccgtcccggtttaaccccgttcccccggg

SEQ ID NO: 389085 - DNA, 751 bp, Homo sapiens
  misc_feature: GZ8MTXP01C0WRN.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctcgtgtagttccatcagttctgatctattcgttgggctggacgtccggcacgaccccgagggagggaagtggagtggatggtgacatacagttactacgtaggacgtacgtactactcctaccgtcctacaacgtacgtccgtactacctaccgtagtttacggacggtactaccggtaccataccgtaaccccgtcctttaccgtccctaacgtaaacctccgtaacccttcccggtaccgaccccggacccggtacccgggtaacccgtaccgggttacctttacgttcgttacggtacggtacgggacgggtaccggtacggtaacgtttcggtttaccgtttaacgtaaacgttcgttaacggtcgggggtacccggttcgggggtaccccgttaacccggttcgtccgttacgttccggttcccttcccttacgtaccgtcccgttacccgaccggaaaccgggtccctaacggttcccggtcccttccccggtcggtccccgttccgttccgccgttaaccgagtccgaccgtccgttcggtaaccgggcaacccgg

SEQ ID NO: 389086 - DNA, 591 bp, Homo sapiens
  misc_feature: GZ8MTXP01EK01S.44.23.C01.1.454.CMB.2.raw
  modified_base (341)..(341): a, c, t, g, unknown or other
  modified_base (347)..(347): a, c, t, g, unknown or other
  modified_base (366)..(366): a, c, t, g, unknown or other
  modified_base (442)..(442): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttgggctggatccggcacgccccgtagggagggaatggagtgatggtgacatccattagtacgtgggcacgtactactctccgtccncaacgntacgtctcaccaatttcgnggacacgtcatcgaaccgcttactcccgtagaacttcgacctccgtgacccgccgacgacgacgtccgttatttcngtggcgtaggcgtagaccgttggtctttacgaattcgtagtcggggtccttgggcctaccgttgggtccacgttcggtaccttccgttcgttacgtccctttaccgaaccgtaacggggccccacgttcccggttccctttccccccgg

SEQ ID NO: 389087 - DNA, 702 bp, Homo sapiens
  misc_feature: GZ8MTXP01BPNRT.44.23.C01.1.454.CMB.2.raw
  modified_base (220)..(220): a, c, t, g, unknown or other
  modified_base (242)..(242): a, c, t, g, unknown or other
  modified_base (287)..(287): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttcctctgtcttcttctgttggagcagcgtcaccatcacgttggccgggngagtcgtaggttcgttttcggngtcttggttcgtccgttaggtttaccaaaacggtaaaaagggggnacggacccctaaggtccctcgtctctcgacgaaacagactaggaagtacgacgtcccgtacaggttcagtgacctagtccgaggtggtcggcccgagtccatctacaacagtcgcgtactggccgctagagtacttcgtgtactaacttattcgtacgttacgagtcctaaagttactacgtacttaacggttcccgtacccccgtttgttaacccggttttccgggaacccgggttaaacgggggaaacccctaaggtaccgttaaacgggaaaacttaacccggtaaaacgtaccgttagggtaacgccgtttacggacccttaacttaaccggttctttaccgggttcctttaccgtaaccgtttcccctttaacccggaccttacgtttacccgtaagttaacgtttaacg

SEQ ID NO: 389088 - DNA, 940 bp, Homo sapiens
  misc_feature: GZ8MTXP01AZIM8.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaaccctgtctctcatctgctactgtctcgtggtacgtttccatctagttctgactctagttcgtggggctggacgtcccggacgaccggccccggaggggagggtaagtgggaggtggtagttgggtagactatcctaagtttacgtacggtgggggtacgtaacgttaacctacctccgttcccgtccctacgtaacgtacgttccgtactccgtaaccgttaacgtttaccgggaacgggtaacctacccggtacccgtaacgttacccggtaaaccccgttcccgtttacccgtacccccgtttaaacggtaaaccccgttaccggtaacccccgttacccgggttacccggggaaccccccgggtccccggggtacccgggtaaccccgggttaaccccgggttttacccggtttttaaccgtttttccgggtttaccgggggttcggggtacccgggggtaaacggggttaccggggtaaaccgtttaccggggttttccgggtttaacccgtttttaacgtaaaacccgggttttccggttaaccgggggtttcccggggggtaccccggtttaccgggggcccccttaaccccgggtttcgggggttaccccttaccggtttcccgggtttccccgttacccgttcccggttaacccgttccccgttaaccccgtaaccgggtaaacccgggtccccgttacccggtttccccggttcccccgtttcccccccggg

SEQ ID NO: 389089 - DNA, 686 bp, Homo sapiens
  misc_feature: GZ8MTXP01BXZBV.44.23.C01.1.454.CMB.2.raw
  modified_base (332)..(332): a, c, t, g, unknown or other
  modified_base (339)..(339): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctactggctcccaggttcgagatgtgacatcgagatgacccagtctccttccttcctgtcttcttctgttggagcagcgtcacatcacttcggccgggcgtagtctagggttccgtttttcggtgtcgttgttcgtccgttggtttaacgaaaacggtaaaaaggggggcgacgggaccccgttaaggtcccttcgtcctcgtcgtanaaaccgngacgtgggaaggtacgacgttccccgtcgtaggttcagtcgaccgtagtccgagggtcgggtcgggaccccggtacgtccactctaccaacctagttcgcgacccgtggcggtacctaggaacgttcttcctgtaccttaaagtttctttcgttacgtactaggctacgttacgtctaacgttcgtcccggttacccgtttcttaacggttttccggaccggtacgggaccgaagtacgtaacgtaaactaaccgaaacgtaacgtgggtcggacttcggaccttacgtacttcgttcgttccttctaaccttcccgtccccgtaactcgttactcgttaattaacg

SEQ ID NO: 389090 - DNA, 690 bp, Homo sapiens
  misc_feature: GZ8MTXP01EFTU4.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgatctattcgtggggctggactccggcacgccccgtagggagggacgtggagtggagtggtgactatacctaagttatacgtggggactacgtactacttcctcccgtcctacgtaacgtacgtcgtctactaccctaagtttcgaacgggactaaccggtccacgtacgaacccgtcttacctaccctagaaacctcgtaccctaccggtacgaccccggcgtccggtaacgtaacccggttcctttaacgttcgtcggttcggggacggtagggtacgtacggtacgttcggttctttacgtaaacgttcgtaagggtcgggtccgttcggcccgtaaccggttcggtcttacgttcgttccttcccgttcgttaccgttcccttacccgaaccggttaacccggggcccttaacggtttcccggttccccgtttcccccggg

SEQ ID NO: 389091 - DNA, 941 bp, Homo sapiens
  misc_feature: GZ8MTXP01AR906.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtctggcccaggactggtgaggccttcgggaaccctgtctctcatctgcactgtctctggtagttccatcagttctgatctattcgttggggctggactccggcacggccccgagggacggggaatgggagtggagtggtgacatcattatacgtggggactacgtactactcctcccgtcctacaacgtacgtcgtcctaccgtaaccctagtttaccgggagggacctaccgtcccaacgttacccggaacccgtcctttaccctccccgtaacgtaaaaaacccgttccgtaaccccgttcccgggtaccgggaaccccggtccccgggaccggggtaacccgttacccgggtttaccccggtttttaacgttttccggttacgggtcggtacccggggtaacgggtaccgggtaacggttaaccggttcggggtttacccttttaccgtaaacgtttacggttacggggttccggggggtcccggggttcggggacccttacccccgggttgggttacccctaacccggtttccggttcccctttaccccgttacccgtaaccccggttacccgtttaaccccccgggaacccgggttaaaccccgggggtacccccgttaaacccggttttccccccggggttccccccggttttacccccccccccgggtttcgggggccccccgttccccccggtttccccgggggtaaccccttaaccccgggaaccggggtaaacccggtcccccgggttaaccccggggtttcccgggggttaacccggggggggtaacccccccgg

SEQ ID NO: 389092 - DNA, 654 bp, Homo sapiens
  misc_feature: GZ8MTXP01B03XE.44.23.C01.1.454.CMB.2.raw
  modified_base (450)..(450): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctcgattctatttcgttggggctggactccggcacggccccgaggggagggaatgggagtggatggtgacatccaattagtacgacggggacgtaacgtaacctactcctcccgtccctacaaggtacgtcgtctacacctatttcggaggtacacgtccatacgaaccccgtcttactccccgtaagaaaccgtcaacccgtccgtacgacccgccggcgaccgtacggtctttatttcgngcgcggagcgtagtacgttgttacttacagtacgtcggcgggtccgtcggaccttaccggtcgtactcgtctcctcgtacctacgtccctacccgaaccggtaacggccccgttacgttcccgttccccgttccccgccggtcccgttcccgttcttcccgaacgaccgaacgtccgtacggttcggtcggggaaccgtaacgg

SEQ ID NO: 389093 - DNA, 607 bp, Homo sapiens
  misc_feature: GZ8MTXP01CNBW2.44.23.C01.1.454.CMB.2.raw
  modified_base (272)..(272): a, c, t, g, unknown or other
  modified_base (300)..(300): a, c, t, g, unknown or other
  modified_base (434)..(434): a, c, t, g, unknown or other
  modified_base (538)..(538): a, c, t, g, unknown or other
  modified_base (561)..(561): a, c, t, g, unknown or other
  modified_base (596)..(596): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggtgctgttgcctggttacaagaaaagggggnacggcccctaaggtcctcgtctctcgtnaaaccgagacgtggaagtagacgtccccgtcaggttcagttgccagtccgaggtcgggtgggccccccggtagtcactcctcgaaaccctatcgccaccgtgccggctgaagtcttcgtgacctatttactttntcgtcagctagtactcagttcgtcgtcccccggtttgttaccgtttcgggaccgaggggtacccaaggccgtaaggaactaccgaacggtactgggtaacgtcnggaccacgtcttacgttccgttntttcccgaacttcccgttcccgtcctagttccgtnttaacgttaac

SEQ ID NO: 389094 - DNA, 539 bp, Homo sapiens
  misc_feature: GZ8MTXP02FSYXD.44.23.C01.1.454.CMB.2.raw
  modified_base (363)..(363): a, c, t, g, unknown or other
  modified_base (418)..(418): a, c, t, g, unknown or other
  modified_base (430)..(430): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgcccccgagggaggggaatggagtggattggtgacatccattatactggggcacgtactactctccgtccctcaagagtcgtctcaccatttcgngggacacgtccatgaaccgcttctccctgaaactgacctccgtgaccgcgcgacncggtcttattcngtgcgagcgagactggtctttcaattctagtcggggccgtggctacccgtggtccactcgtcctcctcacgccttaccaccgaacgggcccagtccggtccttcccccg

SEQ ID NO: 389095 - DNA, 592 bp, Homo sapiens
  misc_feature: GZ8MTXP02HLEFI.44.23.C01.1.454.CMB.2.raw
  modified_base (214)..(214): a, c, t, g, unknown or other
  modified_base (232)..(232): a, c, t, g, unknown or other
  modified_base (384)..(384): a, c, t, g, unknown or other
  modified_base (424)..(424): a, c, t, g, unknown or other
tcagacagtatatacacgaccggtgctcgatttagtacacgtgattagggattggggagtcagaccctgtcaggggacagcatggacatgagggtcccgctcagctcctggggctcctgctgctctggctccaggttcgagatgtgacatcgagatgaccagtctccttccttctgtcttcttctgttggagcagctcacatcacttgccgggnagtcgaggttcgtttggngtctgtgtcgtgttacgaaacgaaaagggaggacggaccgtaacgtcgtcgtctctcgtacgaaacagacgtaggaaggtagacgtccgtacgtacgtcgagtgcacgtacgaggtggtcggccggacgtcactctcactactacgacgacncgcgctagaatatactacgactaacttattacttgtacanactagtatactatacgtcgtcccgttacttacgtttacggtacggaacgggaacgaacgacgtaacgtaaacgtaacgtaaacgaaacgtacgtacggtacgtacgacactaactacttacgttacttactaacttaccttacccgtacctactactacgtaactaac

SEQ ID NO: 389096 - DNA, 516 bp, Homo sapiens
  misc_feature: GZ8MTXP02IL5MK.44.23.C01.1.454.CMB.2.raw
  modified_base (239)..(239): a, c, t, g, unknown or other
  modified_base (423)..(423): a, c, t, g, unknown or other
tcagacagtatatacacgaccggtgctcgatttagtacacgtgattagggattggggagtcagaccctgtcaggggacagcatggacatgagggtcccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaaggggagaggcccctaaagggtcctcgtctctcgtgaaaccagactggaaggtagagtcccgtcaggttcagtgccagtccaggtgtggcccgagtccactctcaccattgcgacctgcgcctgaagattctgcaactattctgtcagcagtatcatagtnccccgttcacttttggccaggggacccaaagctggaaatcaaaacgaactgtggctgcaccatctgtcttctaatcttcctccatcttctata

SEQ ID NO: 389097 - DNA, 544 bp, Homo sapiens
  misc_feature: GZ8MTXP02G16GZ.44.23.C01.1.454.CMB.2.raw
  modified_base (398)..(398): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggattggtgacatcattatactggggcacgtactactctccgtccctcaagagtcgtctcaccatttcgaggacacgtccatgaaccccgcttctccctagaaactgacctccgtgaccgccgcgacacggcgtttattcngtgcgagcgagactggtctttcaatctagtggggccgtggcaccctggtcactgtctctcagtccttccacgaaggccccatccggtccttcccccgtggcccgccctgcctccgacggacgccaccgtcgtcgggggccaaccgg

SEQ ID NO: 389098 - DNA, 553 bp, Homo sapiens
  misc_feature: GZ8MTXP02ISOAF.44.23.C01.1.454.CMB.2.raw
  modified_base (240)..(240): a, c, t, g, unknown or other
  modified_base (270)..(270): a, c, t, g, unknown or other
  modified_base (303)..(303): a, c, t, g, unknown or other
  modified_base (339)..(339): a, c, t, g, unknown or other
  modified_base (402)..(402): a, c, t, g, unknown or other
  modified_base (411)..(411): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggtttacaacgaaaaggggnaggcccctaaggtcctcgtctctcgtgaaaccngactgggaagtagacgtcccgtcaggttcagtgccngtccagggtggtggccccggagtcccacgtctcaccattagccgactgcggcctgaagattcngctaacttnttctgtcagcagtatcattagtcgaccccgttctacttgggtccaagggggacccaaaggccttaggaaaacttaccgaaaacgactggtacggctcggacacccatcctgtccttcaattccttcccgcatcctagactta

SEQ ID NO: 389099 - DNA, 554 bp, Homo sapiens
  misc_feature: GZ8MTXP02JENIC.44.23.C01.1.454.CMB.2.raw
  modified_base (508)..(508): a, c, t, g, unknown or other
  modified_base (514)..(514): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatggagtggattggtgacatccattatactggggcgacgtactactctccgtcctcaagagtcgtctcaccatttcgaggacacgtcatgaacccgctctcctgaactgacctccgtcgaccgccgcgacacggtccgtttattcctgtgcgaggcgagacctgggtctttcgaattctagtcggggcctgggcctacccgtggtcactggtctcctcacgtcttaccaccaacgggcccagtccggtcctttcccccngggccnccctgacctcccgaggacgccaccgtcgtcggggcaacgg

SEQ ID NO: 389100 - DNA, 541 bp, Homo sapiens
  misc_feature: GZ8MTXP02HE032.44.23.C01.1.454.CMB.2.raw
  modified_base (359)..(359): a, c, t, g, unknown or other
tcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaatggagtggattggtgacatccattatactgggctacgtactactctccgtcctcaacgagtcgtctcacatttcgngggacacgtccatcgaaccgcttcctccctgaaacctcgacctccgtgacccgccgcggacaccggccgtttattctgtgcgagcgagactggtctttcaatctagtggggcctggcacccgtggtcacgtcgtcctcctcacgccttccaccgtacggccccagtccggtcctttcccccg

SEQ ID NO: 389101 - DNA, 550 bp, Homo sapiens
  misc_feature: GZ8MTXP02GDRTO.44.23.C01.1.454.CMB.2.raw
  modified_base (388)..(388): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccgagggaggggaatggagtggattggtgacatccattatacgtggggcgacgtactactctccgtcctcaacgagtcgtctcaccatttcgagggacacgtccatgaaccgcttcnccctgaaactgacctcgtgaccgccgcgacacggccgtttattctgtgcgagcagactggtctttcaatctagtggggccgtggccacccgtggtcacttcgtcctcctcgacgtccttacccaaccgaaacgggcccctaagtcccggttcctttcccccg

SEQ ID NO: 389102 - DNA, 564 bp, Homo sapiens
  misc_feature: GZ8MTXP02HJXRI.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccctcaagacgtcgtctcaccatttcgaggacacgtccatgaacccgcttctcctgaaactcgacctccgtcgaccgccgcgaccacggccgtttattctgtgcgaggcgagacgtgtctttcaatctagtgggccgtggctaccgtggtcactgtcctcctcacgtcttccaccgtaagggcccctacgtccggtccttcccccgtcggcccgtccctcggcctaaccgacggacgccacccgtcgtcgggggccaccgg

SEQ ID NO: 389103 - DNA, 560 bp, Homo sapiens
  misc_feature: GZ8MTXP02IWZ42.44.23.C01.1.454.CMB.2.raw
  modified_base (542)..(542): a, c, t, g, unknown or other
  modified_base (548)..(548): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggattggtgacatccattatactggggcgacgtactactctccgtccctcaagagtcgtctcacctatttcgagggaccacgtccatgaaccccgcttcctccctgaaactcgacctccgtgaccgccgcgacacggctttattcgtgtgcgaggcgagacgtggtctttcgaatcgtagtcgggggccgtggctacccgtgggtccacgtcgtcctcctcacgtcttccgaccaacgggcccagttccggtccttcccccgtggcccgccctgcctccgaggcnccaccncgtcggggcacg

SEQ ID NO: 389104 - DNA, 543 bp, Homo sapiens
  misc_feature: GZ8MTXP02G61HZ.44.23.C01.1.454.CMB.2.raw
tcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccaggagggaatggagtggatggtgacatccattatactgggcgacgtactactctccgtcctcaacgagtcgtctcaccatttcgagggcacgtccatcgaaccgcttctccctgaaactgacctccgtgaccgccgcggacacggccgtttattcctgtgcgtaggcgtagactggtctttcgaatcgtagtcggggccgtgggccacccgtggtcacgtcgtcctcctcacgcttcccaccgaacgggcccacgtccggtctttcccccg

SEQ ID NO: 389105 - DNA, 556 bp, Homo sapiens
  misc_feature: GZ8MTXP02G6EKG.44.23.C01.1.454.CMB.2.raw
  modified_base (369)..(369): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgcccccgagggacgggaagtgggagtggagttggtgacatccattatacgtggggcgacgtactactctccgtcctcaacgagtcgtctcacctatttcgngggacacgtccatcgaaccgcttcctccctgaaacctcgacctccgtcgaccgccgcggacacggcctttattctgtgcgaggcgagactggtcttcaatctagtcggggacctggcctacccgtggtcacgtcgtcctcctcacgtcgttacccaccgacggcccacgtccggtcctttcccccgg

SEQ ID NO: 389106 - DNA, 408 bp, Homo sapiens
  misc_feature: GZ8MTXP02HZM00.44.23.C01.1.454.CMB.2.raw
  modified_base (369)..(369): a, c, t, g, unknown or other
  modified_base (403)..(408): a, c, t, g, unknown or other
tcagacagtatatacacgaccggtgctcgatttagtacacgtgattagggattgggatggatgaagccctatagtggcaacacgggctttgcccagaagttccaaggcagagttagtatgaccaggagcacctcccaggtacagtctacatggaactgagcagcctgagatctgaggacacggccgtgtatttctgtgcgagagccaccagcacctggcttgacttgtggggccagggaaccctggtcaccgtctcctcagcctccaccaagggccccatccggtcttccccctggccgcccctgcctccaggacgccacctccgagagcacagcggccctgggctgcccctgtcaggctacttccatntactgtctgagcgggctgggccaaggcgcatagnnnnnn

SEQ ID NO: 389107 - DNA, 549 bp, Homo sapiens
  misc_feature: GZ8MTXP02G3UKX.44.23.C01.1.454.CMB.2.raw
  modified_base (363)..(363): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccagggacgggaatggagtggattggtgacatccattatactggggcgacgtactactctccgtccctcaacgagtcgtctcaccatttcgngggacacgtccatcgaaccgcttctccctagaaactgaacctccgtcgaaccgcccgcggaccgacggtccgtttatttctgttgccgtaggcgagactggttcttcaatctagtggggcctggcctaccgtggtccactcgtctccgtcacgcttcccacgtacggccactccggtcttcccccg

SEQ ID NO: 389108 - DNA, 513 bp, Homo sapiens
  misc_feature: GZ8MTXP02GT6OF.44.23.C01.1.454.CMB.2.raw
  modified_base (502)..(502): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatggagtggattggtgacatccattatactggggcgacgtactactctccgtcctcaagagtcgtctcaccatttcgagggacacgtcatgaacccgcttctcctgaaactgacctccgtgaccgccgcgacacggccgtttattctgtgcgaggcgagactggtcttcatctatgggccgtggcacctggtcacgtcgtctctcagcttcaccaaggccatcgtctccctcgcgccctgctccgcgacgcacnctcggggcacg

SEQ ID NO: 389109 - DNA, 550 bp, Homo sapiens
  misc_feature: GZ8MTXP02ICEBI.44.23.C01.1.454.CMB.2.raw
  modified_base (240)..(240): a, c, t, g, unknown or other
  modified_base (270)..(270): a, c, t, g, unknown or other
  modified_base (304)..(304): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccggcgagtcaggtcgttttcggngctgttgccttggtttcaacgaaaaggggnaggcccctaaaggtcctcgtctctcgtgaaaccngactggaagtagagtcccgtcaggttcagtgccagtccaggtggtgggcccgagtccgactctcaccattgccgtactggcgcctgaagtatctgctaacttattctgtcagcagtatcatagtcgtccccgttctacgttttcggccgtagggaccaaagcgttaggaaactacgaaacgtaactgtacggctggcaaccatctcgttcttcaacgttccttcccgctaacttcctagtacttaa

SEQ ID NO: 389110 - DNA, 585 bp, Homo sapiens
  misc_feature: GZ8MTXP02JDCP4.44.23.C01.1.454.CMB.2.raw
  modified_base (240)..(240): a, c, t, g, unknown or other
  modified_base (269)..(269): a, c, t, g, unknown or other
  modified_base (303)..(303): a, c, t, g, unknown or other
  modified_base (395)..(395): a, c, t, g, unknown or other
  modified_base (399)..(399): a, c, t, g, unknown or other
  modified_base (409)..(409): a, c, t, g, unknown or other
  modified_base (445)..(445): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggtttcaacgaaaaggggnacggcccctaaggtcctcgtctctcgtgaaaccngactggaagtagacgtcccgtcaggttcagtcgccagtccgaggtggtggccccggagtccactcgtcaccattgcgacctgcgctgaaagnttcngctaactttnttctgtcagctagtatctagtacgtccgtcccgttnttacgtttcggaccgacgggaccaggtacgtagaaactacgaaacgtacgtggtcggactacgacctactacttccgttacgttacctttacgtaacctttcccgttaccccgtacctacgtttccgtacgttaacttac

SEQ ID NO: 389111 - DNA, 571 bp, Homo sapiens
  misc_feature: GZ8MTXP02IS9TP.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatggagtggagttggtgacatccattatacgtgggcgacgtactactctccgtcctcaagagtcgtctcaccatttcgagggacacgtccatcgaacccgcttctccctagaaactcgacctccggtgacccgtcccgaccggaccgacggtccgtttatttctgtgcgaggcgagactcgggtctttcgaaatctagtggggtccgtggctacccgtggtcactcgtctcctcacgtcttccacgaacgggcccacgtcggtccttccccgtcggccgtccctcgcctccgacggacgccaccgtcgtcggggacaccgg

SEQ ID NO: 389112 - DNA, 566 bp, Homo sapiens
  misc_feature: GZ8MTXP02G5V4M.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatgggagtggattggtgacatcattatacgtgggcgacgtactactctccgtcctacaagacgtcgtctcactattcgaggacacgtccatcgaacccgcttctccctagaactcgacctcgtcgaccgccgcgacacggtctttattctgtgcgaggcgagactcggtcttcaatcgtagtcggggccgtggcctaccgtggtccacgtcgtcctcctcacgtcttccgaccgtacgggccctacgtccgtccctcccctcgggccctcccgtcgccgtccgacggacgccgaccgtccgtcgggggacaccgg

SEQ ID NO: 389113 - DNA, 642 bp, Homo sapiens
  misc_feature: GZ8MTXP02HL72J.44.23.C01.1.454.CMB.2.raw
  modified_base (270)..(270): a, c, t, g, unknown or other
  modified_base (396)..(396): a, c, t, g, unknown or other
  modified_base (400)..(400): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaacgaaaagggggngaggcccctaaggtcctcgtctctcgtgaaaccagactggaaggtgagtccccgtcaggttcagtcgccagtccgaggtggtgggccggagtcccactctcacctattagcgactgcgcctgaagnttcngctaacttattctgtcagcagttatctatagtacgtccccgtttctaaccgtttttcggacctaacgggggaaccaaacggtccgtaaggaaaacgttaaccgaaaaccgtaaaccgttaggtaacgggtcgtacggtacctaaccccgtaattaccgttcggttcctttaccgtaaacgtttcccctttcccccggtacccccttaaagttcccgttacgtaaatttaacgtttaaaaccg

SEQ ID NO: 389114 - DNA, 541 bp, Homo sapiens
  misc_feature: GZ8MTXP02JW82E.44.23.C01.1.454.CMB.2.raw
  modified_base (362)..(362): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcagccccagggaggggaatggagtggattggtgacatccattatacgtggggcgacgtactactctccgtcctcaacgagtcgtctcacctatttcgngggacacgtccatgaaccgcttctccctgaaactcgacctccgtcgaccgccgcggacacggtcctttattctgtgcgagcgagactggtctttcaatctagtcgggcgtggccaccgtggtctactcgtcctcctcacgtccttccaccgtacggcccacgtccggtccttcccccgg

SEQ ID NO: 389115 - DNA, 582 bp, Homo sapiens
  misc_feature: GZ8MTXP02HK0ML.44.23.C01.1.454.CMB.2.raw
  modified_base (297)..(297): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgtgggctggatccggcacgccccgagggagggaatggagtggattggngacatccattatacgtgggcgacgtactactctccgtcatccaagatcgtctcacctattcggagggacaccgtaccatacgaaacccgtcttcctccctagaaacctcgaccctccgtacgaccgccgcggaccacggtcctttattccgtgtcgtcgaggcgagtactggttcttcaatctagtcgggccgtcggcctaccgtggtcctacgttcgtccttcctacgtaacgtcctttacccgacccgtaaacgggcccctaacggtttcccggtttcccccg

SEQ ID NO: 389116 - DNA, 548 bp, Homo sapiens
  misc_feature: GZ8MTXP02GT4KF.44.23.C01.1.454.CMB.2.raw
  modified_base (239)..(239): a, c, t, g, unknown or other
  modified_base (269)..(269): a, c, t, g, unknown or other
  modified_base (390)..(390): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttcaaacgaaaagggggnaggcccctaaggtcctcgtctctcgtagaaaccagactggaaggtagacgtcccgtcaggttcagtgccagtcaggtggtgggccgagtccactctcacattagcgactgcggcctgaagnttctgctaacttattctgtcagcagtatcatagtcgtcccgttctacgttttggccgtaggggaccaagctaggaaactacgaaacgaacgtgtacggactcgacacctactctacgtcttcacttccttcccgacctactcctacgtacttattaac

SEQ ID NO: 389117 - DNA, 543 bp, Homo sapiens
  misc_feature: GZ8MTXP02GNIQS.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatgggagtggattggtgacatccattatactggggcgacgtactactctccgtcctcaagagtcgtctcaccatttcgaggacacgtcatgaacccgcttctcctgaaactcgacctccgtgaccgccgcgacacggcctttattctgtgcgaggcgagactggtctttcaatctagtcggggccgtggcctaccgtggtcactgtctcctcacgcttccaccgaacggcccatccggtccttccccgcggcccgccctcgcctccgacggacgcaccgtcgtcgggggcacgg

SEQ ID NO: 389118 - DNA, 536 bp, Homo sapiens
  misc_feature: GZ8MTXP02JNC60.44.23.C01.1.454.CMB.2.raw
  modified_base (240)..(240): a, c, t, g, unknown or other
  modified_base (268)..(268): a, c, t, g, unknown or other
  modified_base (301)..(301): a, c, t, g, unknown or other
  modified_base (413)..(413): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggttcaacgaaaaggggnaggcccctaaggtcctcgtctctcgtgaaaccngactggaagtagagtcccgtcaggttcagtgccagtccaggtggtgggccccggagtccactctcaccatgcgactgcgctgagattctgactacttattctgtcagcagtntcatagtcgtcccgttctacgtttcgggccgtaggggaccaaggccgttaggaaaactccaaaacgtactggtacggctgaccaccatctcgtcttcaacttccttcccgctatctgtataac

SEQ ID NO: 389119 - DNA, 526 bp, Homo sapiens
  misc_feature: GZ8MTXP02HKPVB.44.23.C01.1.454.CMB.2.raw
  modified_base (436)..(436): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtcggttctgggacactatttcactctcacatcagcagcctgcagcctggatatttcgcgtacttattactgaccaaactaattattcttttttanccgttactagtttcgccgtaggggaccaagctaggagatacaaaaggtaactgtaggctcgcaccatcgtgtctcactctcccgtactac

SEQ ID NO: 389120 - DNA, 569 bp, Homo sapiens
  misc_feature: GZ8MTXP02I0P7T.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatcattatactggggcgacgtactactctccgtcctcagagtcgtctcaccatttcgagggacacgtccatcgaacccgcttctccctgaaactgacctccgtgacccgccgcgaccacggccgtttattctgtgcgaggcgagactggtctttcaatctatggggccgttggctaccgtggtcactcgtctcctcacgtcttccaccaacgggccctagtccgggtcctttcccccgtcggccgccccgttcgcccgtccgacgggacgtccaaccgtttccgtcgggggaccaaccgg

SEQ ID NO: 389121 - DNA, 587 bp, Homo sapiens
  misc_feature: GZ8MTXP02IN87M.44.23.C01.1.454.CMB.2.raw
  modified_base (310)..(310): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggaatggagtggattggtgacatccattatactggggcgacgtactactctccgtcctcaagngtcgtctcacctatttcgaggacacgtccatcgaacccgtcttctccctagaaactgacctcgtgaccgccgcgacacggcctttattctgtcgcgaggcgtagacttggtctttcaaattctagttcggggccgttggcctacccgtggtcaccgtcgtctcctcacgtcttacccaccgaacgggtccctacgttccggttccctttcccccgtcgggtcccgtcccctcgcccttccgacggacgtccgaccgttccgtcgggggaccaaccgg

SEQ ID NO: 389122 - DNA, 549 bp, Homo sapiens
  misc_feature: GZ8MTXP02F6YCC.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtcctcaagagtcgtctcaccatttcgagggacacgtcatgaaccccgcttctcctagaaactcgactccgtgaccgccgcgacacggccgtttatttctgtgcgaggcgagactggtctttcaatctagtggggccgtggcacccgtggtcactgtctcctcacgcttccaccaacgggcccagtccggtcttccccctcggccgcccctcgcctccgacggacgccaccgtcgtcgggggcaccgg

SEQ ID NO: 389123 - DNA, 522 bp, Homo sapiens
  misc_feature: GZ8MTXP02JQPZO.44.23.C01.1.454.CMB.2.raw
  modified_base (271)..(271): a, c, t, g, unknown or other
  modified_base (304)..(304): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctggtttcaacgaaaaggggnaggcccctaaggtcctcgtctctcgtgaaaccngactggaagtagagtcccgtcaggttcagtgccagtccaggtggtgggccccggagtccactctcaccattcgcgacctgccggcctgaagattctgctaacttatttctgtcagcagtatcatagtcgcccgttcacttttcggcctaggggacccaagctaggaaatcaaacgactgtggctgcaccatctgtcttcaatccttccgcatctgata

SEQ ID NO: 389124 - DNA, 524 bp, Homo sapiens
  misc_feature: GZ8MTXP02HY20X.44.23.C01.1.454.CMB.2.raw
  modified_base (362)..(362): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccaggagggaatggagtggattggtgacatccattatacgtgggcgacgtactactctccgtccctcaacgagtcgtctcaccatttcgngggacacgtccatgaaccgcttctccctgaaactcgactccgtgaccgccgcgacacgcgtttattctgtgcgtagcgagactgtcttcaatctatgggcgtggcaccgtggtcactcgtctcctcacgcttccaccaacggaccgactcgtctttcccccg

SEQ ID NO: 389125 - DNA, 565 bp, Homo sapiens
  misc_feature: GZ8MTXP02GGMH3.44.23.C01.1.454.CMB.2.raw
  modified_base (220)..(220): a, c, t, g, unknown or other
  modified_base (239)..(239): a, c, t, g, unknown or other
  modified_base (271)..(271): a, c, t, g, unknown or other
  modified_base (391)..(391): a, c, t, g, unknown or other
  modified_base (394)..(395): a, c, t, g, unknown or other
  modified_base (401)..(401): a, c, t, g, unknown or other
  modified_base (405)..(405): a, c, t, g, unknown or other
  modified_base (431)..(431): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggtcgttttcggngctgttgccttggtttacaaacgaaaaggggngacggcccctaaggtcctcgtctctcgtgaaaccagactggaaggtagacgtcccgtccaggttcagtgccagtccaggtggtggccgagtccactctcacattacgcgactgcgctgantcnncacttnttcngtcagcagtatcatagtcgtcccttntacgtttggaccgaggggtaccaagtcgtaggaaaactacgaaaacgaacgtggtacggtactcggacctaacccgtattcttacgttccttactaacttcctttccccgactactacctagtacttattaacg

SEQ ID NO: 389126 - DNA, 598 bp, Homo sapiens
  misc_feature: GZ8MTXP02JPGUS.44.23.C01.1.454.CMB.2.raw
  modified_base (239)..(239): a, c, t, g, unknown or other
  modified_base (268)..(268): a, c, t, g, unknown or other
  modified_base (397)..(397): a, c, t, g, unknown or other
  modified_base (401)..(401): a, c, t, g, unknown or other
  modified_base (446)..(446): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgcctggttcaaacgaaaaggggnacggcccctaaggtcctcgtctctcgtagaaaccagactggaaggtagacgtcccgtcaggttcagtcgccagtccgagggtcggtgggccggagtccactctcacattagcgactgccggctgaacgnttcngctaacttattctgtcagcaagtactacatacgtcgccccgtttntacgttttcgggaccgaagggggtaccaaggtccgtaagggtaaaacttcgaaaaacgtaccgtggtacggtactacggaccaacccgtattccgttacgttcctttactacttcccgttccccgacctacttcctagtaacttagtttaac

SEQ ID NO: 389127 - DNA, 634 bp, Homo sapiens
  misc_feature: GZ8MTXP02I7VGS.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccgacagccccagggagggaatggagtggagttggtgacatccatatactgggcgacgtactactctccgtcctcaagagtcgtctcaccatttcgaggacacgtccaatcgaaccccgtcttctccctagaaactcgaacctccgtacaccgccgccgacacggtcgtttattctgtgcgaggcgagtactcggtctttacaattcgtaagtcgggggccttgggcctacccgtgggttccacgtcgttctcccttcaacggttcctttacccgaaccgaaacggggtcccctaacgttccgggttcccttccccccgttcgggccccggtaaccccctttgccccgttaacccgaacgggtaaccgccctaacccgtccggttcggggggaccaaccccgggg

SEQ ID NO: 389128 - DNA, 523 bp, Homo sapiens
  misc_feature: GZ8MTXP02INNCV.44.23.C01.1.454.CMB.2.raw
  modified_base (241)..(241): a, c, t, g, unknown or other
  modified_base (271)..(271): a, c, t, g, unknown or other
  modified_base (368)..(368): a, c, t, g, unknown or other
  modified_base (519)..(519): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgccttggtttcaacgaaaaggggnaggacccctaaggtcctcgtctctcgtagaaaccagactggaagtagacgtcccgtcaggttcagtgccagtccaggtggtggcccgagtccactcncaccatgcactgcgctgatatctgctaacttattctgtcagcagtatcatacgtcgtcccgttctacgtttcggaccgtacggggaccagcgtaggaaatcaaaacgatcgtaggctgcacatctcgtctcaattcctaccgacactctanataa

SEQ ID NO: 389129 - DNA, 543 bp, Homo sapiens
  misc_feature: GZ8MTXP02F1DPH.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccccgcttctccctgaaactgacctccgtgaccgccgcgacacggtccgtttatttctgtgcgaggcgagactggtctttcaatctatggggccgtggcaccctggtcactgtctcctcacgcttccacctaacgggcccatccggtccttcccccgtggccgccctgcctccgaggcgcaccgtcgcggggcacg

SEQ ID NO: 389130 - DNA, 565 bp, Homo sapiens
  misc_feature: GZ8MTXP02I2D8J.44.23.C01.1.454.CMB.2.raw
  modified_base (241)..(241): a, c, t, g, unknown or other
  modified_base (270)..(270): a, c, t, g, unknown or other
  modified_base (304)..(304): a, c, t, g, unknown or other
  modified_base (398)..(398): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaggggngaggcccctaaggtcctcgtctctcgtgaaaccngactggaagtagacgtcccgtcaggttcagtgccagtccaggtggtgggccccggagtccactctcaccattacgcgacctgccgcctagaagnttctgctaacttatttctgtcagcagtatcattagtcgtccccgttctacgttttcggccgtacggggacctaagcgttaggaaaacttccgaaaacgacgtaggtcggacttacgcaacctacttctcgttcttacaacttccttcccgcctactctagtacttaa

SEQ ID NO: 389131 - DNA, 571 bp, Homo sapiens
  misc_feature: GZ8MTXP02JDIFW.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatgggagtggattggtgacatccattatacgtggggcgacgtactactctccgtcctcaagagtcgtctcacctatttcgaggacacgtccatcgaaccccgtcttctccctagaactcgacctccgtcgaccgccgcgaccacggtccgtttattctgtgcgaggcgagactcggtctttcaatctagtcggggccgtggcctaccgtcggtcacgtcgtcctcctcacgccttccaccgaacggccctacgtccggtccttccccgtcggccgtcccgtcgccgtccgacggacgccaccgtcgtcggggacaccgg

SEQ ID NO: 389132 - DNA, 570 bp, Homo sapiens
  misc_feature: GZ8MTXP02H34QV.44.23.C01.1.454.CMB.2.raw
  modified_base (220)..(220): a, c, t, g, unknown or other
  modified_base (270)..(270): a, c, t, g, unknown or other
  modified_base (404)..(404): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggnagtcaggttcgttttcggtgcttgttgcctggtttcaacgaaaagggggngaggcccctaaaggtcctcgtctctcgtagaaaccagactggaaggtagagtccccgtcaggttcagtgccagtccagggtggtgggccggagtccactctcaccattacgcgacctgccggcctgaagattcngcaactttatttctgtcagctagtatcatagtcgtaccccgtttctacgttttcggaccctagggggacccaagaccgtagggaaaactacgaaaacgaactgtacggctagacacctatcttcgtcttacacttccttacccgcctacttctacgtattaactac

SEQ ID NO: 389133 - DNA, 574 bp, Homo sapiens
  misc_feature: GZ8MTXP02FRVYX.44.23.C01.1.454.CMB.2.raw
  modified_base (363)..(363): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcagcccccgagggacggggaatggagtggattggtgacatccattatacgtggggcgacgtactactctccgtcctcaacgagtcgctcactatttcgnggggacacgtccatcgaaccgcttctccctgaaactcgacctccgtgaccgccgcggacacggtctttattctgtgcgtaggcgagactggtctttacgaattcgtagtcgggggccgttgggcctacccgtggtcctacgttcgttcctcctcgacgtcctttacccgaaccgaacgggtcccctaacgtcccggttcctttccccccgg

SEQ ID NO: 389134 - DNA, 658 bp, Homo sapiens
  misc_feature: GZ8MTXP02JLCCW.44.23.C01.1.454.CMB.2.raw
  modified_base (253)..(253): a, c, t, g, unknown or other
  modified_base (294)..(294): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatctacgttcggccgggacgtacgtcgtagggtttccggttttcggngtcttggttcgtccgttggttacaaaacggtaaaagggggngaccggtacccgtaaggtcctcgttctcgtcgtaacgaaaccagtacgtggaaaggtcgaccgtcccgtacgtaggttcagtcgacctacgtccgagggtggcgggcgacgtccactcacactagttcgccgtacgtggccggtctaggaagtcttcgtcgacttaactttacgttctcgtacacgtctaagtactcgtagttacgtccgtcccgttacgttacgtttccggaccggtacggggaacctaacggtacgtaaggtaaacgtacgaaaaccgtacgtacggtcggtactcgacctaaccgtgtcttacgtccttactacttcccgttacccgacttactccgtactattacttacg

SEQ ID NO: 389135 - DNA, 633 bp, Homo sapiens
  misc_feature: GZ8MTXP02JLI7K.44.23.C01.1.454.CMB.2.raw
  modified_base (272)..(272): a, c, t, g, unknown or other
  modified_base (307)..(307): a, c, t, g, unknown or other
  modified_base (354)..(354): a, c, t, g, unknown or other
  modified_base (401)..(401): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctggtttacaaacgaaaagggggnacggcccctaaggtcctcgtctctcgtagaaaccngactggaaggtagacgtcccgtcaggttcagtgccagtccaggtggngggccgagtccactctcacattagcgacctggccggcctagaacgtnttctgctaaactttatttctgttcagctaagtatcatacgtcgtccccgtttctacgtttttcgggaccgtacgggggtaccaaacggtcgtaagggaaaacttacgaaaaccggtaaccgtaggtcgggtacttacggacctaaacccgtaacttccgttcgtttacctttaccgtacttcccgtttacccccggtcctaacgttccttacggtaactttaacgtttaacg

SEQ ID NO: 389136 - DNA, 568 bp, Homo sapiens
  misc_feature: GZ8MTXP02G68C0.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccgagggagggaatggagtggattggtgacatccattatacgtggggcgacgtactactctccgtcctcaagagtcgtctcacctatttcgaggacacgtccatcgaaccccgtcttcctccctgaaactgacctccgtgaccgccgcgacacggtccgtttatttctgtgcgaggcgagactggtctttcaatctagtggggccgtggcacctggtcactcgtctcctcacgccttccgaccgtaacgggccctacgtccggtccttcccccgcggcccgtccctcggccctccgacggtacgccaccgtccggtcgggggacaccgg

SEQ ID NO: 389137 - DNA, 546 bp, Homo sapiens
  misc_feature: GZ8MTXP02JMW84.44.23.C01.1.454.CMB.2.raw
  modified_base (339)..(339): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccagggacgggaatggagtggattggtgacatccattatactggggcgacgtactactctccgtcctnaacgagtcgtctcacatttcgaggggacacgtccatgaaccgtcttctccctgaaacctgacctccgtgaccgccgcgacacggtccgtttattcgtgtgcgtaggcgagactggtcttcaatctagtcggggctggcaccctggtcacgtcgtcctccgtcacgtccttccgaccgtaacgggcccagtcccggtctttcccccgg

SEQ ID NO: 389138 - DNA, 560 bp, Homo sapiens
  misc_feature: GZ8MTXP02HJQBM.44.23.C01.1.454.CMB.2.raw
  modified_base (370)..(370): a, c, t, g, unknown or other
tcagacagtatatacacgaccggtgctcgatttagtacacgtgattagggattggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgaggggaggggaagtggagtggagttggtgacatccattatacgtggggcgacgtactactctccgtccccctacaagacgtcgtctcacntttcgaggacacgtccatcgaaacccgcttcctcccttagaaaacctcgaaccctccgtcgacccgccgaccggacacggtccgtttatttcctgttgcgaggcgagtactggtctttcaatctagtcggggcctggccaccgtggtcacgtcgtctcgtcacgcttccaccgaacggcccattccccgg

SEQ ID NO: 389139 - DNA, 585 bp, Homo sapiens
  misc_feature: GZ8MTXP02GQRJC.44.23.C01.1.454.CMB.2.raw
  modified_base (368)..(368): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcacgcccccgagggaggggaagtggagtggagttggtgacgatccattatacgtggggcgacgtactactctccgtccctcaacgagtcgtctcaccatttcgnggacacgtccatcgaaccgcttctccctagaaacctcgaaccctccgtgacccgcccgcggacaccggtccgtttaatttccgtgtcgcgtaggcgaggactcggtctttcgaatctagtcgggggtccgtggccacccgtgggtccactcggtcctccctcgacgtccttcccgaaccgtaaacggggcccctagtcccggttcctttccccccgg

SEQ ID NO: 389140 - DNA, 525 bp, Homo sapiens
  misc_feature: GZ8MTXP02HSF9M.44.23.C01.1.454.CMB.2.raw
  modified_base (241)..(241): a, c, t, g, unknown or other
  modified_base (270)..(270): a, c, t, g, unknown or other
  modified_base (394)..(394): a, c, t, g, unknown or other
  modified_base (398)..(398): a, c, t, g, unknown or other
  modified_base (501)..(501): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaggggnaggccctaaagggtcctcgtctctcgtagaaaccagactggaagtagagtcccgtcaggttcagtgccagtccgaggtggtggcccggagtccactctcaccattgcgacctgccgctgaagtnttcngctaactttattctgtcagctagtatcatagtcgcccttctactttggccgagggacaagctaggaaactacaaacgaactgtagctagcaccatctgtcttnaacttctcccgcctatctgtacta

SEQ ID NO: 389141 - DNA, 554 bp, Homo sapiens
  misc_feature: GZ8MTXP02G2F2S.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcacgcccccgagggacgggaatggagtggagttggtgacatccattatacgtgggcgacgtactactctccgtcctcaacgagtcgtctcactattcgagggacacgtccatcgaaccgcttcctccctagaaactcgacctcgtcgaccgccgcgacacggtcttattctgtgcgtagcgagactggtcttacaatcgtagtcgggccgtggccgaccgtggtcctactcgtcctccgtcacgtccttacccgaccgaacgggccctacgtcccggtcctttcccccgg

SEQ ID NO: 389142 - DNA, 590 bp, Homo sapiens
  misc_feature: GZ8MTXP02GRFFQ.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaatgggagtggagttggtgacatccattatacgtgggcgacgtactactctccgtcctcaagagtcgtctcacctatttcgaggacacgtccatcgaaccccgtcttctccctagaaactcgacctccgtcgaccgccgcgacacggtccgtttattctgtgcgaggcgagactggtcttacgaatcgtagtgggccgtggcctaccgtggtcacgtcgtcctcctcacgtccttaccgaccgtaacggccccagttccggtccctttcccccgcggcccgtccccgttcggaccctccgaacggacgcccgtaccgtcggtaccgggggcaacccgg

SEQ ID NO: 389143 - DNA, 558 bp, Homo sapiens
  misc_feature: GZ8MTXP02G13G1.44.23.C01.1.454.CMB.2.raw
  modified_base (436)..(436): a, c, t, g, unknown or other
  modified_base (511)..(511): a, c, t, g, unknown or other
  modified_base (538)..(538): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctgggctggatccggcagccccaggaggaatggagtggattggtgacatccattatacgtggggcacggtactactctccgtcctcaagagtcgtctcacctatttcgaggggtacacggtccatcgaaaccgctttcctccctagaaaccttgacctcgtgacccgcgcgacaccgtcgtttattcngtcgcgaggcgagactggtcttacaatcgtagtcggggcgtcgggcacccgtggtcctaacgttcgtctcccttnaacgtccttcccaaccgtaaggccccngtcccggtcctttcccccgg

SEQ ID NO: 389144 - DNA, 542 bp, Homo sapiens
  misc_feature: GZ8MTXP02HN1FX.44.23.C01.1.454.CMB.2.raw
  modified_base (387)..(387): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcagcccccagggagggaatggagtggattggtgacatccattatactggggcgacgtactactctccgtccctcaacgagtcgtctcacatttcgagggacacgtccatcgaaccgcttccnccctgaaacctgacctcgtgaccgccgcgacacgccgtttattctgtgcgtagcgagactggtctttcaatctagtggggccgtggcacccgtggtcactcgtctcctcacgccttccaaccgtaacgggccctagtcccggttccttcccccgg

SEQ ID NO: 389145 - DNA, 530 bp, Homo sapiens
  misc_feature: GZ8MTXP02H26NF.44.23.C01.1.454.CMB.2.raw
  modified_base (501)..(501): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcagccccagggaggaatggagtggattggtgacatccatatactggggcgacgtactactctccgtcctcaagagtcgtctcaccatttcgagggacacgtcccatcgaaccgcttcctccctgaaactgacctccgtagaccgccgcgacacggtccgtttattcctgtcgcgaggcgagtactggtctttacaatctagtggggcctggcacccgtggtcacgtcgtctcctcnctctccacgacgccacgtccgtcctcccg

SEQ ID NO: 389146 - DNA, 403 bp, Homo sapiens
  misc_feature: GZ8MTXP02GDZZT.44.23.C01.1.454.CMB.2.raw
  modified_base (296)..(296): a, c, t, g, unknown or other
  modified_base (365)..(365): a, c, t, g, unknown or other
  modified_base (398)..(403): a, c, t, g, unknown or other
tcagacagtatatacacgaccggtgctcgatttagtacacgtgattagggattgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaccctggtcaccgtctcctcagcctccaccaaggcccatcggtcttccccctggccnccctgctccaggagcacctccgagagcacagcggccctggggctgccctggtcaaggctacttcctatntactgtctgagcgggctgggcaaggcgcatagnnnnnn

SEQ ID NO: 389147 - DNA, 567 bp, Homo sapiens
  misc_feature: GZ8MTXP02GGRHK.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattatacgtgggcgacgtactactctccgtcctcaacgagtcgtctcacctatttcgagggacacgtccatcgaaccgcttcctccctagaaactgacctccgtgacccgccgcgacacggtcgtttattctgtgcgagcgagacgtggtcttacaatcgtagtcggggccgtcggcctacccgtggtcctacgttcgtcctcctctacgtccttacccgaccgtaacgggcccctacgtcccggtcctttcccccgg

SEQ ID NO: 389148 - DNA, 713 bp, Homo sapiens
  misc_feature: GZ8MTXP02IH9KU.44.23.C01.1.454.CMB.2.raw
  modified_base (214)..(214): a, c, t, g, unknown or other
  modified_base (298)..(298): a, c, t, g, unknown or other
tcagacagtatatacacgaccggtgctcgatttagtacacgtgattagggattgggggctttctgagagtcaaggacctcctgtgcaagaacatgaagcgacctgtggtttttcctcctgctggtggcagctcccagatgggtcctgtcccaggtgcagctgcaggagtcgggcccaggactggtgaggccttcgggaaccctgtctctcatcngcactgtctctggatttccatcagttctgatcattctgggctggatccggcacgccccgagggagggaatggagtggagttggngacatccaattatacgtggggaccgtacgttactaccttcctcccgtaccctcaacgtacgtccgtctaccaccttagtttccgaggggacctaacgtcccagttaccgaacccgtcttccctaccctagaaaacctcgtaacccctccggtacgaaccccgcccggtcggaaccgtacccgggttaccgtttagtttccgtacggttggaccgggtaagggtcccggtaagttaccgttacgggttcttttaaccgaaagtttccgttaaaggtcgggggtacccgttcgggccctaacccggttcgggtcctaaccgttcggttccctcccgtactaacggttccccttaccccgaaaacccggtaaaccggggtccccctaacggttaccccggttcccctttcccccccgg

SEQ ID NO: 389149 - DNA, 536 bp, Homo sapiens
  misc_feature: GZ8MTXP02HUBYJ.44.23.C01.1.454.CMB.2.raw
  modified_base (241)..(241): a, c, t, g, unknown or other
  modified_base (271)..(271): a, c, t, g, unknown or other
  modified_base (305)..(305): a, c, t, g, unknown or other
  modified_base (400)..(400): a, c, t, g, unknown or other
  modified_base (448)..(448): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngcttgttgcctggttcaaacgaaaaggggnaggcccctaaggtcctcgtctctcgtagaaaccngactggaaggtagacgtcccgtcaggttcagtcgccagtccaggtggtgggccccgagtccactctcaccattcgcgactgccggcctgaaagtnttctgactaacttatttctgtcagtcagtatcatagtcgtccccgttntacgttttggaccgtaggggaccaagctaggaaactacgaaacgaactgtcgctgacacatctcgtctcaatcctaccgcatctgata

SEQ ID NO: 389150 - DNA, 562 bp, Homo sapiens
  misc_feature: GZ8MTXP02HLFQL.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcagcccccgagggaggggaatggagtggattggtgacatccattatacgtggggcgacgtactactctccgtcctcaacgagtcgtctcacatttcgagggacacgtccatgaaccgcttctccctgaaactgacctccgtgaccgccgcggaccacggccgtttattcgtgtgcgtaggcgagacgttggtctttcgaaatcgtagtcgggggccgttggcctacccgttggtcctacgtctcctaccctcacgtccttccaccgtaacggcccacgttccgtcctttcccccg

SEQ ID NO: 389151 - DNA, 591 bp, Homo sapiens
  misc_feature: GZ8MTXP02IKO18.44.23.C01.1.454.CMB.2.raw
  modified_base (402)..(402): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaagtggagtggattggtgacatccattatacgtgggcgacgtactactctccgtcctcaagagtcgtctcaccatttcgaggacacgtcatcgacccgcttctcctagaaactgacctccgtcgaccgccgcgacacggtctttattcngtgcgaggcgagacttggtctttacaattctagtcgggggccttggctacccgtggtcacgtcgtcctccctcgacgtccttacccgaccgaaccgggtcccctacggttcccggtcccttccccccgtcggtcccgccccgttcgaccctcccgaggaccgccgacccgttcggacgggggccaccgg

SEQ ID NO: 389152 - DNA, 560 bp, Homo sapiens
  misc_feature: GZ8MTXP02I1IRB.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatggagtggattggtgacatccattatactggggcgacgtactactctccgtcctcagagtcgtctcaccatttcgaggacacgtccatcgaaccccgcttctcctagaaactcgacctcgtgaccgtcgcgacacggtcctttattctgtgcgaggcgagactggtctttcaatctagtggggtccgttggccaccgtggtcacgtcgtctcctcacgtccttccaccgaacggcccagttccggtccttccccgtcggcccgtccccgttcgcctccgacggacgccaccgttcgtcgggggcaccgg

SEQ ID NO: 389153 - DNA, 641 bp, Homo sapiens
  misc_feature: GZ8MTXP02G8V6A.44.23.C01.1.454.CMB.2.raw
  modified_base (239)..(239): a, c, t, g, unknown or other
  modified_base (267)..(267): a, c, t, g, unknown or other
  modified_base (301)..(301): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgtttcggngctgttgcctggttcaacgaaaaggggnacggcccctaaggtcctcgtctctcgtgaaaccngactggaaggtgagtcccgtcgaggttcagtgccaggtccaggtcggtgggccccgagtcccactctcaccattacgccgacctgccggcctaggaaatacttcctgacctaaactttatttctgtcagctaagttactcattacgtcgtccccgtttctacgttttcggaccgtacgggggaaccctaaggaccgttaagggaaaacttaccgaaaaaccggaaacttgggtacgggtaccttacggaccgtaaccctaaagttcctttaacggtccctttaccgtaagtttcccctttacccccggaccttaagttcccttaacggtaaactttaacg

SEQ ID NO: 389154 - DNA, 563 bp, Homo sapiens
  misc_feature: GZ8MTXP02GQCJ3.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccgagggagggaatgggagtggattggtgacatccattatacgtggggcgacgtactactctccgtccctcaagacgtcgtctcaccatttcgaggacacgtccatcgaacccgcttcctcctagaaactcgacctccgtcgaccgccgcgacacggtcctttattctgtgcgaggcgagtactggttcttacaatctagtcggggtccgtggcctaccgtggtcacgtcgtcctcctcacgtccttccaccgaacggcccacgtccgtcctccccgtcgcccgtccctcgcctccgacgtacgccaccgtcgcggggcaccgg

SEQ ID NO: 389155 - DNA, 541 bp, Homo sapiens
  misc_feature: GZ8MTXP02J3E1C.44.23.C01.1.454.CMB.2.raw
  modified_base (242)..(242): a, c, t, g, unknown or other
  modified_base (302)..(302): a, c, t, g, unknown or other
  modified_base (350)..(350): a, c, t, g, unknown or other
  modified_base (370)..(370): a, c, t, g, unknown or other
  modified_base (383)..(383): a, c, t, g, unknown or other
  modified_base (416)..(416): a, c, t, g, unknown or other
  modified_base (449)..(449): a, c, t, g, unknown or other
  modified_base (462)..(462): a, c, t, g, unknown or other
  modified_base (539)..(539): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatcgcagccccagggnggaatggagtggattggtgacagtccattatacgtgggcacgtactactctccgtccctnaagagtcgtctcaccatttcgaggacacgtccatcgaaccccgcttcnccctagaaactgacctccgngacccgcgcgacncgtctttatctgtgcgaggcgagcgtgtctttnaagttcagtcggggcctgggcctccgtggtccncgtctcttacccnctacgtcctaccacgacgtcctacgtccgtcctcccgcgccgacctcgcctcgacgcgccgtaccgtcggacggacncg

SEQ ID NO: 389156 - DNA, 591 bp, Homo sapiens
  misc_feature: GZ8MTXP02HPF42.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggaggggaagtgggaggtggagttggtgacagtccattatacgtgggcgacgtactactctccgtcctcaagagtcgtctcactattcgaggacacgtcatcgaaccccgcttcctcctagaaactcgaaccctccgtcgacccgccgccgacctacggtccttttattctgtcgcgacggcgagtacgtggttcttacaacttcgtagtcggggtccgtcggtccgtaccgtggtctacgtcgtcctcctcacgtccttccgaccgaacgggccctacgttccggtcccttccccgtcggcccgccctcgcctccgacgacgccaccgttccgcggggacaccgg

SEQ ID NO: 389157 - DNA, 526 bp, Homo sapiens
  misc_feature: GZ8MTXP02IBTWX.44.23.C01.1.454.CMB.2.raw
  modified_base (240)..(240): a, c, t, g, unknown or other
  modified_base (272)..(272): a, c, t, g, unknown or other
  modified_base (305)..(305): a, c, t, g, unknown or other
  modified_base (506)..(506): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcttcctgtcttcttctgttggaggcagcgtcaccatcacttgccgggcgagtcaggtcgttttcggngctgttgccttggtttcaaacgaaaagggggnaggcccctaaggtcctcgtctctcgtgaaaccngactggaagtagagtcccgtcaggttcagtgccagtccaggtggtggccccggagtccactctcaccattcgcgactgccgcctgaatctctgactaacttattctgtcagcagtatcatagtcgtcccgttctacgttttggaccgtaggggaccaagctaggaaactacaaacgactagtcgctgcacatctcgtctcnctctcccgacatctgactac

SEQ ID NO: 389158 - DNA, 548 bp, Homo sapiens
  misc_feature: GZ8MTXP02GPG65.44.23.C01.1.454.CMB.2.raw
  modified_base (362)..(362): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatggagtggattggtgacatccattatacgtggggcgacgtactactctccgtcctcaacgagtcgtctcaccatttcgnggacacgtccatcgaaccgcttcctccctgaaactcgacctcgtcgaccgccgcgacacggtcctttattctgtcgcgagcgagactggtctttcatcgtagtcggggctcggcctacccgtggtccacgttcgtcctcctcacgtccttcccaaccgacgggcccacgtccggtcctttcccccg

SEQ ID NO: 389159 - DNA, 581 bp, Homo sapiens
  misc_feature: GZ8MTXP02HCEZR.44.23.C01.1.454.CMB.2.raw
  modified_base (241)..(241): a, c, t, g, unknown or other
  modified_base (272)..(272): a, c, t, g, unknown or other
  modified_base (305)..(305): a, c, t, g, unknown or other
  modified_base (398)..(398): a, c, t, g, unknown or other
  modified_base (402)..(402): a, c, t, g, unknown or other
  modified_base (411)..(411): a, c, t, g, unknown or other
  modified_base (415)..(415): a, c, t, g, unknown or other
  modified_base (427)..(427): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttacaacgaaaagggggnaggcccctaaggtcctcgtctctcgtgaaaccngactggaaggtagacgtcccgtcaggttcagtcgccagtccaggtggtgggccccggagtcccacgtctcaccatcgcgactgcgcctgaagnttcngctaacttnttcngtcagcagttanctatagtcgtcccctttctacgttttcggacccgtagggggaacccaaggtcctaagggaaaacttccgaaaaacgtaacgttggtacggccttagcctaaccactccttcggtcctttacaattcccttacccgcctattcctacgactttaa

SEQ ID NO: 389160 - DNA, 577 bp, Homo sapiens
  misc_feature: GZ8MTXP02IAKU4.44.23.C01.1.454.CMB.2.raw
  modified_base (526)..(526): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaatggagtggattggtgacatccattatacgtggggcgacgtactactcctccgtccctcaagacgtcgtctcacctatttcggagggacacgtccatcgaaccccgtcttcctccctagaaactcgaccctccgtcgaccgccggccgaccacggtcctttattctgtgcgaggcgagactggttctttcaattctagtcggggccgtggccacccgtggtcactcgtctctcacgctaccacgaacgggccagttccggtccttcccccgnggcccgtcccgtcgcctccgacggacgccaccgtcggtcgggggccaccgg

SEQ ID NO: 389161 - DNA, 576 bp, Homo sapiens
  misc_feature: GZ8MTXP02GXNKC.44.23.C01.1.454.CMB.2.raw
  modified_base (350)..(350): a, c, t, g, unknown or other
  modified_base (459)..(459): a, c, t, g, unknown or other
  modified_base (523)..(523): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttgggctggactccggcacgcccccgagggagggaagtggagtggagttggtgacatcctattatacgtggggcgacgtactactctccgtcctcaacgngtcgtctcactatttcgacgggtacacggtccatcgaaccgtcttacctccctagaaacctcgacctccgtcgacccgccgcggacacggtccgtttattcgtgtgcgngcgagactggttcttacgaatctagtcggggcgtcggccaccgtggtccacggttctccttccncgtacgtccgttaccacccgtaacggccctacgttcccggtcctttcccccgg

SEQ ID NO: 389162 - DNA, 560 bp, Homo sapiens
  misc_feature: GZ8MTXP02IWOHH.44.23.C01.1.454.CMB.2.raw
  modified_base (367)..(367): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggacggggaatggagtggattggtgacatccattatacgtgggcgacgtactactctccgtcctcaacgagtccgtctcacctatttcgnggggacacgtccatcgaaccgcttctccctgaaacctgacctcgtgaccgccgcgacaccggtcgtttactttctgtgcggagccgagacctggtctttcgactcgtagtcgggccgtgcctacccgtggtccacttcgttcctcctcacgtccttcccgacgtacgggccctacgtccggtcctttcccccg

SEQ ID NO: 389163 - DNA, 551 bp, Homo sapiens
  misc_feature: GZ8MTXP02IHFOT.44.23.C01.1.454.CMB.2.raw
  modified_base (446)..(446): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattatacgtggggcgacgtactactctccgtccctcaacgagtcgtctcacctatttcgagggacacgtccatcgaaccgcttctccctgaaacctgcctccgtgacccgccgcgactcggcgtttattctgtgcgngcgagactggtctttcaatctagtggggccgtggcctacccgtggtccacttcgtcctcctcacgtccttcccaacgacgggcccagttcccggtccttcccccg

SEQ ID NO: 389164 - DNA, 536 bp, Homo sapiens
  misc_feature: GZ8MTXP02GJO9Z.44.23.C01.1.454.CMB.2.raw
tcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatgggagtggattggtgacatccattatacgtggggcgacgtactactctccgtccctcaacgagtcgtctcaccatttcgagggacacgtccatcgaaccgcttcctccctgaaactgacctcgtcgaccgccgcgacacgccgtttattctgtgcgtagcgagactggtctttcaatctagtcgggcgtggctccgtggtcacgtgtcctcctcagcttccactacggcccacgtccggtccttcccccg

SEQ ID NO: 389165 - DNA, 593 bp, Homo sapiens
  misc_feature: GZ8MTXP02F34XC.44.23.C01.1.454.CMB.2.raw
  modified_base (241)..(241): a, c, t, g, unknown or other
  modified_base (270)..(270): a, c, t, g, unknown or other
  modified_base (410)..(410): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngctgttgcctggttacaacgaaaaggggnacggcccctaaggtcctcgtctctcgtagaaaccagactgggaaggtagacgtccccgtcaggttcaggtcgccgagtccagggtgggtgggcccggagtccactctcaccattcgcgacctgccgcctagaagtattcngactaactttattctgtcagcagtatacattagtcgtccccgttctaccgttttggacccgtaggggaccctaaggcgtaaggaaaacttaccgaaaacgtaacgtggtacggacgttcgaccaactacttcttcgtcctttacaacgttcccttccccgactacttcctagtaaactttaac

SEQ ID NO: 389166 - DNA, 552 bp, Homo sapiens
  misc_feature: GZ8MTXP02JA9AX.44.23.C01.1.454.CMB.2.raw
tcagacagtatatacacgaccggtgctcgatttagtacacgtgattagggattggggctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatcggcagccccaggagggaatggagtggattggtgacatccattatactggggcgacgtactactctccgtcctcaacgagtcgtctcactatttcgaggggacacgttccatcgaaccgcttcctccctgaaacctcgacctccgtgaccgccgcgacacgtccgtttattcgtgtgcgaggcgagtactggtcttcaatcgtagtcggggcgtggcacccgtggtccaacgttcgtcctcctcagtccttcccgaaccgaacggggtcccacgtccggttcctttcccccgg

SEQ ID NO: 389167 - DNA, 643 bp, Homo sapiens
  misc_feature: GZ8MTXP02HCBNI.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgaggggagggagtggagtggtagttggtgacatcatatacgtgggcgacgtactactacctccgtcctcacgtacgtcgtctcctactacgttcgcgggactacgtcctacgtcgtaaccgcttcctccctacgaaacctacgacctccgtccgtaccgcccggacggaccgtaccggtaccgtttacgtttcgtcgttcggcggtagggacggacggtaacgttcgttcgtttactaacgttacgttaacggtcgggggtccggtcggtaccgtacccgttcggtccgtacctcggttcctccgtccgtacgtccgttaccgaccgaaccggtccctacgttccccggttccctttccccccgg

SEQ ID NO: 389168 - DNA, 661 bp, Homo sapiens
  misc_feature: GZ8MTXP02FT92A.44.23.C01.1.454.CMB.2.raw
  modified_base (276)..(276): a, c, t, g, unknown or other
  modified_base (315)..(315): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttgccgttggtttacaaacgaaaaggggngacggcccctaagggtccctcgtctcgtcgtagaaaccngactggaaggtagacgtcccgtcgaggttcagtgccagtccgaggtggtcggccccggagtcccgatctacaccagttacgccgacctgccggcctaggaaagtcttctgtactaactttagtttctagtcagctagtatctatagtcgtacccgttctacgttttcggaccgtaacggggacccaaggtacgtaaggtaaaacttaccgaaaaacggtaacgtacgggtacgtaccgttacggaccctaaacctacggtttccttacggtttaccctttacgtaaccgttttcccccgttacccccgtaccctaaccgtttccttaacggttaacttttaaaacg

SEQ ID NO: 389169 - DNA, 565 bp, Homo sapiens
  misc_feature: GZ8MTXP02H21TS.44.23.C01.1.454.CMB.2.raw
  modified_base (241)..(241): a, c, t, g, unknown or other
  modified_base (271)..(271): a, c, t, g, unknown or other
  modified_base (306)..(306): a, c, t, g, unknown or other
  modified_base (420)..(420): a, c, t, g, unknown or other
  modified_base (451)..(451): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcagggtcgttttcggngctgttgccttggttcaaacgaaaaggggnaggcccctaaaggtccctcgtctctcgtgaaaccngactgggaaggtagacgtcccgtcaggttcagtgccagtccaggtggtgggccccggagtccacgtctcaccattgcgacctgcggcctgaaatattctgactaactttattcngttcagcagtactcatacgtctacccgtttntacgtttttgggacgagggggtaaccaaaggccgttagggaaaattccaaaacgaacgtggtggacttggacaccatctcgttcttcaacttccttcccgcatcctatattaac

SEQ ID NO: 389170 - DNA, 736 bp, Homo sapiens
  misc_feature: GZ8MTXP02IV16I.44.23.C01.1.454.CMB.2.raw
  modified_base (271)..(271): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctggtttcaacgaaaaggggngaggacccctaaggtcctcgtctctcgtgaaaccagactggaaggtagagtcccgtcaggttcagtgccagtccaggtggtcgggcccggagtcccacgtctccacctattacggccgaacccttggccggtccctaggaaacgtactttcctcggactaaactttaatttccttggttaccaaggtcctaaggttactaccgtagttaacggttccgttaccccccggttttacgttaaccgttttttcggggaccccgttaaacggggggaaccccctaaaggggtacccgttaaggggtaaaaaacctttaccgaaaaaaaccgggtaaacccgtttaggggttacgggtaccgtttacgggtacccaaacccccgtaatttcccgttacggtttccctttacctaaccgtttcccttttcccccggacccttaactttcccgttacggtaacttttaaacg

SEQ ID NO: 389171 - DNA, 561 bp, Homo sapiens
  misc_feature: GZ8MTXP02IHM0X.44.23.C01.1.454.CMB.2.raw
  modified_base (443)..(443): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggacgggaatggagtggagttggtgacatccattagtacgtgggcacgtactactctccgtcctacaacgacgtcgtctcactagtttcgagggacacgtccagtacgaccgcttcctcctagaaacctcgacctcgtcgaccgccgcgacgcgtacgttattcgngtgcgtagcgagactggttacttacaatcgtagtcggggtccgtggcctaccgttcggtctacgttcgtcctcctcacgtccttccaaccgacggccctacgtccgtccttcccccgg

SEQ ID NO: 389172 - DNA, 527 bp, Homo sapiens
  misc_feature: GZ8MTXP02H3S2S.44.23.C01.1.454.CMB.2.raw
  modified_base (357)..(357): a, c, t, g, unknown or other
  modified_base (450)..(450): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcacgccccgagggagggaatggagtggatggtgacatccatatacgtgggcacgtactactctccgtcctcacgagtcgtctcacatttcgngggacacgtccatcgaaccgcttctccctagaaactcgacctccgtgaccgccgcggacacggtctttattctgtgcgagcgagactgtcttnaatctagtgggcgtaggcaccgtggcactcgtcctcctcagtccttccgaaccacggcccagttccggtcctccccg

SEQ ID NO: 389173 - DNA, 627 bp, Homo sapiens
  misc_feature: GZ8MTXP02JDRE2.44.23.C01.1.454.CMB.2.raw
  modified_base (488)..(488): a, c, t, g, unknown or other
  modified_base (517)..(517): a, c, t, g, unknown or other
  modified_base (556)..(556): a, c, t, g, unknown or other
  modified_base (572)..(572): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggactccggcacgccccgagggaggagtggagtggagttggtgactatcctattagtacgtggggacgtacgtactacgttcctcccgtcctacgaacgtacgttccgtcctacacctagtttacggacggggacctacgtaccagtacgaacccgtccttcctaccctagtaaacctcgacccttccgtcgacccgcccgacgaccgaccggttcctttatttccgngtcgcgaggcgaggtacgtggttccttanaacttcgtaggtcggggtcctcggcctaccgtggtaccncgttcgtcctcccgtnacgtccttacccgaacccgtaacgggccctacggttcccggtccctttcccccgg

SEQ ID NO: 389174 - DNA, 547 bp, Homo sapiens
  misc_feature: GZ8MTXP02JPXKY.44.23.C01.1.454.CMB.2.raw
  modified_base (365)..(365): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccattcagttctgatcattcttggggctggatccggcagcccccagggaggggaatggagtggattggtgacatccattatactggggcgacgtactactctccgtccctcaacgagtcgtctcaccatttcgnggggacacgtccatgaaccgcttcctaccccgaaactcgacctcgtcgacccgccgcgacgacggtcgtttacttcgtgtcgtcgaggtcgagacgtggtctttcaattctagtcggggcgtggccaccgtggtcactgtctctcagtctccgacgtacggcccagtccgtccttccctcgg

SEQ ID NO: 389175 - DNA, 532 bp, Homo sapiens
  misc_feature: GZ8MTXP02FQQ9O.44.23.C01.1.454.CMB.2.raw
tcagacagtatatacacgaccggtgctcgatttagtacacgtgattagggattgggggctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccccagggaggggaatggagtggattggtgacatccattatactggggcgacgtactactctccgtccctcaacgagtcgtctcaccatttcgaggggacacgtccatgaaccgcttctccctgaaactgacctccgtgaccgccgcggacacggccgtttattctgtgcgaggcgagactggtctttcaatctatggggccgtggcaccctggtcactcgtctcctcagcttccaccacgggcccatccggtcttcccccg

SEQ ID NO: 389176 - DNA, 591 bp, Homo sapiens
  misc_feature: GZ8MTXP02HK5O9.44.23.C01.1.454.CMB.2.raw
  modified_base (266)..(266): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggtgctgttgcctggtttcaacaaaaggggnaggcccctaaggtcctcgtctctcgtgaaaccagactggaaggtagagtcccgtcaggttcagtgccagtccaggtggtgggccgagtccactctcaccattagcgacctgccggcctgaagattctgcaacttattctgtcagcagtatcatagtcgtccccgttctacgtttttggcccgtagggggaacccaaaggccgttagggaaaacttacgaaaacggtaaacctggtacggcttacggacaccctaattccttaggtcctttactaacttccgtttcccccgaccctaacttcccttacggaactttaactttaacg

SEQ ID NO: 389177 - DNA, 677 bp, Homo sapiens
  misc_feature: GZ8MTXP02FWVEO.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatctagttctgtatctattcgttgggctggactccggcacgccccggagggagggagtggagtggtagttggtgacatactagttatcggtgggccgtacgtactactcctccgtccctacgaacgtcgtccgtctacctacctagtttccgggacggggtacctaccggtaccacgtaccgaacccgtccttaccctcccgtaagtaaaccctccgaacccttcccggtacgacccccggccggtaccggaacccgtaccgggttacccgttttaatttccggtggttacggccgggtacgggccgtaaggtaccgttcgggttacctttacgaagtttccgtaggtccgggggtccgtcggcctacccggttggtcctacgttcgttcctcctcgacgttccgtacccgacgacgggccctagttcccggtcccttccccg

SEQ ID NO: 389178 - DNA, 547 bp, Homo sapiens
  misc_feature: GZ8MTXP02JOWDC.44.23.C01.1.454.CMB.2.raw
  modified_base (245)..(245): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgaggngggaatggagtggattggtgacatccgattatacgtgggcgacgtactactctccgtcctcaagagtcgtctcaccatttcgaggacacgtccatcgaccccgcttctccctagaactcgacctccgtgacccgccgcgacacggtcctttattctgtgcgagcgagactggtctttcatctagtgggccgtcgcaccgtggtcacgtcgtctctcacgccttccaccgacggcccacgccgtcctccccgtcggcccgcccgtcgcctccgacggacgccaccgtccgtcgggggcaccgg

SEQ ID NO: 389179 - DNA, 590 bp, Homo sapiens
  misc_feature: GZ8MTXP02H2DNJ.44.23.C01.1.454.CMB.2.raw
  modified_base (292)..(292): a, c, t, g, unknown or other
  modified_base (537)..(537): a, c, t, g, unknown or other
  modified_base (588)..(588): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcatttcgttggggctggactccggcgacgccccggagggagggagtggaggtggagtggtgacgatctattagtacgngggacgtacgtactctctcctcctcaagactcgtctctactattcgaggacacgtccatcgaaccctcttctcctagaactcgacctcgtcgcgccgcgacgtcgtcgtttactcgtgtgcgagcgagtcgtcggttcttacgaacttcgtagtcgggggtccgtcgccgtaccgttggtctccgtgtccctcttcgatccttaccgaccgaacgggtccctcgttcccggtcccttcccccggnggtccccgccttcgacctcccggaggaccgcctaccgtccggcgggaaccncg

SEQ ID NO: 389180 - DNA, 576 bp, Homo sapiens
  misc_feature: GZ8MTXP02FP2Y5.44.23.C01.1.454.CMB.2.raw
  modified_base (368)..(368): a, c, t, g, unknown or other
  modified_base (439)..(439): a, c, t, g, unknown or other
tcagacagtatatacacgaccggtgctcgatttagtacacgtgattagggattggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaagtggagtggagttggtgacatccattatacgtggggcgacgtactactctccgtcccctcaagagtcgtctcacctntttcgagggtacaccgtccatcgaaaccgtcttctccctagaaactcgaccctccgtcgaccgccgcgacncggtccgtttattctgtgcgtagggcgagacgttggtctttacgaattccgtagtcggggccgtggcctacccgtggtctacgtcgtcctcctcgtacgtccttcccgaccgtaacgggcccctaacgtttccccgg

SEQ ID NO: 389181 - DNA, 584 bp, Homo sapiens
  misc_feature: GZ8MTXP02GD30H.44.23.C01.1.454.CMB.2.raw
  modified_base (242)..(242): a, c, t, g, unknown or other
  modified_base (272)..(272): a, c, t, g, unknown or other
  modified_base (308)..(308): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttacaacgaaaaggggnacggcccctaagggtcctcgtctctcgtagaaaccngactgggaaggtagacgtcccgtcaggttcagtgccagtccaggtggtgggccccggagtccactctcacctattcgcgacctgccgcctgaagtattctgctaacttattctgtcagcagtatcatagtcgtccccgttctacgttttcggaccgtaagggggaccaaggctagggtaaaactaccgaaaaacgtaacgttggtacgggcttaggacaacccattcctacgttctttacaacgttccttaccccgctaactctacgtactttaac

SEQ ID NO: 389182 - DNA, 586 bp, Homo sapiens
  misc_feature: GZ8MTXP02HVRYJ.44.23.C01.1.454.CMB.2.raw
  modified_base (418)..(418): a, c, t, g, unknown or other
  modified_base (539)..(539): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggaggggaatgggagtggatggtgacatccattatacgtggggcgacgtactactctcccgtcctcaagagtcgtctcacctatttcgaggacacgtccatcgaacccgcttcctccctagaaactcgacctccgtcgaccgccgccgacgaccggccgtttattctgtgcgnggcgagtacgtggttacttctaaatcgtagtcggggtccgtggccgtaccgttgggtacctacgtgtcctcctacacgtccttacccaccgaacggcccacgttccggtcccttcccccgnggcccgtccctcgcctccgacgacgtccaccgtcgtacggggcacgg

SEQ ID NO: 389183 - DNA, 573 bp, Homo sapiens
  misc_feature: GZ8MTXP02GKU30.44.23.C01.1.454.CMB.2.raw
  modified_base (240)..(240): a, c, t, g, unknown or other
  modified_base (270)..(270): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggttcaaacgaaaagggggnacggcccctaaggtcctcgtctctcgtgaaaccagactggaaggtgacgtcccgtcaggttcagtgccagtccgaggtggtgggccggagtccactctcaccattacgccgacctggccggcctaggaagtattctgctaaacttatttctgttcagcagtatcatagtcgtccccgtttctacgttttcggcccgagggggtacccaagtcgtaggaaaactacgaaaacgtaactggtacgctagacacctagtctcgtcttctacttccgttacccgcctacttctagtaacttactacg

SEQ ID NO: 389184 - DNA, 627 bp, Homo sapiens
  misc_feature: GZ8MTXP02H26FB.44.23.C01.1.454.CMB.2.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaaccctgtctctcatctgcactgtctctggtagtttccatcagttctgatcattcgttggggctggatccggcacgcccccgaggggacggggaagtggaggtggagttggtgacatcctattatacgtggggcgacgtactactctccgtcccctcaagtacgtcgtctcacctgtttcgaggtaccacgtccacgtcgaaacccgtcttcctccctagaaacctcgaccctcgtcgacccgccgccggacacggtccgtttatttccgtagtcgcggtagggcgagtacgtggtttccttctaaacgttcgtaaggtcgggggtccgtcgggtacctaacccgttcgggtcctaccgttcgttcccttccctaacgtacgtacccgtttcccgaacccgtaacggggtcccctacgtttccccggg

SEQ ID NO: 389185 - DNA, 575 bp, Homo sapiens
  misc_feature: GZ8MTXP02I50XT.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccagggagggaatggagtggattggtgacagtccattatacgtgggcgacgtactactctccgtcctcaagagtcgtctcacctatttcgaggacacgtccatcgaaccccgcttctccctagaaactgacctccgtgaccgccgccggacaccggtccgtttattctgtgtcgaggcgagactggtctttcaatctagtggggccgttggccaccgtggtccacgtcgtctcctcacgtcttacccaccaacgggccctagtcccggtccttcccccgttggcccgtcccgtcgaccctccgacggacgccgtaccgtcgtcgggggaccaccgg

SEQ ID NO: 389186 - DNA, 527 bp, Homo sapiens
  misc_feature: GZ8MTXP02IIKFN.44.23.C01.1.454.CMB.2.raw
  modified_base (507)..(507): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtcctcaagagtcgtctcaccatttcgaggacacgtccatgaaccccgcttctccctgaaactgacctccgtgaccgccgcgacacggcctttattctgtgcgaggcgagactggtctttcaatctagtgggccgtggcaccctggtcactgtctcctcagcttccacaacggcccatcggtccttcccctgccgccctgctccgngacgcactcgtcggggcacg

SEQ ID NO: 389187 - DNA, 563 bp, Homo sapiens
  misc_feature: GZ8MTXP02JKMG2.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggaatggagtggattggtgacatccattatacgtggggcgacgtactactcgtccgtcctcaagagtcgtctcaccatttcgaggacacgtccatcgaaccccgtcttcctcctagaaacctgacctccgtcgaccgccgcgacacggtctttattcctgtgtcgagcgagactggtctttcatcgtagtggggccgtggctacccgtggtcacgtcgtctcctcgacgccttccaccgaacggccctacgtccggttcctcccccgtcggcccgtcccgtgcctccgacgtcgccaccgtcggtcggggcaccgg

SEQ ID NO: 389188 - DNA, 552 bp, Homo sapiens
  misc_feature: GZ8MTXP02GRIHW.44.23.C01.1.454.CMB.2.raw
  modified_base (466)..(466): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatggagtggattggtgacgatccattatactggggcgacgtactactctccgtcctcaagagtcgtctcaccatttcgaggacacgtcatgaaccccgcttctccctgaaactcgacctccgtcgaccgccgcgacacggtccgtttattctgtgcgtaggcgagactggtctttcaattctagtggggccgtggcaccgtggtcactcgtctccncagcttccacaacggcccagtccggtccttccccgtcggccgccctcgcctccgacggacgtccacccgtcgtcgggggccaccgg

SEQ ID NO: 389189 - DNA, 597 bp, Homo sapiens
  misc_feature: GZ8MTXP02F2A4A.44.23.C01.1.454.CMB.2.raw
  modified_base (354)..(354): a, c, t, g, unknown or other
  modified_base (402)..(402): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatggagtggattggtgacatccattatacgtggggcgacgtactactctccgtcctcaagagtcgtctcaccatttcgaggacacgtccatgaaccccgtcttcncctgaaactcgacctccgtcgaccgccgcgacacggccgtttatttcngtcgcgaggcgagtacgtcggtctttcgaatctagtcggggtcctggccacccgttgggtcctaacgttcgtccttcctcgtacgcctttaccgaccgtaaacggggcccctacgttccgggtccctttccccccgtcggtcccgccccttcgaccctccgaacggacgccacccgtcgtacggggaccaaccgg

SEQ ID NO: 389190 - DNA, 543 bp, Homo sapiens
  misc_feature: GZ8MTXP02H2YVG.44.23.C01.1.454.CMB.2.raw
  modified_base (237)..(237): a, c, t, g, unknown or other
  modified_base (265)..(265): a, c, t, g, unknown or other
  modified_base (383)..(383): a, c, t, g, unknown or other
  modified_base (421)..(421): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgtttcggngctgttgcctggtttcaacaaaaggggnaggcccctaaggcctcgtctctcgtgaaaccagactggaaggtgacgtcccgtcaggtcagtgcagtcaggtggtggccgagtccatctcaccattagcactgcggcctgaagattcngcaacttattctgtcagcagtatcatagtcgccccttnacgttttgacctagggggaccctaagaccgtaggaaacgttcgaaaacgaactgtaacggcttacggcaacccatcttacgtcttcacttccgttcccgacctactcctgtaactatttaac

SEQ ID NO: 389191 - DNA, 565 bp, Homo sapiens
  misc_feature: GZ8MTXP02FPKWQ.44.23.C01.1.454.CMB.2.raw
  modified_base (428)..(428): a, c, t, g, unknown or other
  modified_base (522)..(522): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacgcccccgagggacgggaatggagtggattggtgacatccattatacgtggggcgacgtactactctccgtccctcaacgtacgtcgtctcacatttcgagggacacgtcatcgaaccgtctctccctagaaactcgacctcgtcgacccgccgcgacnccggtcctttatttcgttcgcgacggcgagtacgttgtcttactatcgttagtcggggtccgtcggctaccgtcggtctacgtcgtcctcctcncgtcttccaccgtacggacctactccggtcccttcccgtccgg

SEQ ID NO: 389192 - DNA, 591 bp, Homo sapiens
  misc_feature: GZ8MTXP02IEDX0.44.23.C01.1.454.CMB.2.raw
  modified_base (266)..(266): a, c, t, g, unknown or other
  modified_base (279)..(279): a, c, t, g, unknown or other
  modified_base (357)..(357): a, c, t, g, unknown or other
  modified_base (567)..(567): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggatggagtggatggtnacatcatatacgngggcgacgtactactctccgtcctacaagacgtcgtctcacctatttcggaggacacgtccatcgaaccccgtcttcncctagaactcgacctccgtacgacccgccgaccgacgtcgtctttacttctgtgcgagcgagtactggttcttacaatctagtcgggccgtggctaccgtggtacctacgtcgtcctccgtctacgccttcccaaccgaaccggtccctacgttcccggttcccttcccccggtcggccccgtcccgtcgcccgtaacccgaggtacccnccgtaccgtcggacgggacaccgg

SEQ ID NO: 389193 - DNA, 542 bp, Homo sapiens
  misc_feature: GZ8MTXP02FYH9F.44.23.C01.1.454.CMB.2.raw
  modified_base (427)..(427): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccacatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggacgggaatggagtggattggtgacatccattatacgtgggcgacgtactactctccgtcctacaacgagtccgtctcactatttcgagggacacgtccatcgaaccgtcttctccctagaaactcgacctccgtgaccgccgcggacncgtctttattctgtgcgagcgagactgtcttcaatctagtcgggcgtggcaccgtggtcacgtcgtctcctcacgccttacccgacgtacgggccctagttccgtccttcccccg

SEQ ID NO: 389194 - DNA, 623 bp, Homo sapiens
  misc_feature: GZ8MTXP02JFRQP.44.23.C01.1.454.CMB.2.raw
  modified_base (503)..(503): a, c, t, g, unknown or other
  modified_base (599)..(599): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggaatggagtggattggtgacatcctattagtacgtggggacgtacgtactacgtcctcccgtcctacaagagtccgtctcacctattcgaggacacgtccatcgaaccccgtccttcctccctagaaactcgaccctccgtcgacccggccgccggaccacggtccgttttattcgtgtcgacggaggcgtacgacgttcggtctttacaattcgtagttcgggggccgttcggaccgtacccgtggtaccncgttcgtccttcctctactcccttacccgacccgaaacgggcccctacgttcccggtcccttccccgcggtccctcccgtcgccgtccgacggacncctaccgtcggtcggggacaccgg

SEQ ID NO: 389195 - DNA, 708 bp, Homo sapiens
  misc_feature: GZ8MTXP02GX1GK.44.23.C01.1.454.CMB.2.raw
  modified_base (223)..(223): a, c, t, g, unknown or other
  modified_base (242)..(242): a, c, t, g, unknown or other
  modified_base (271)..(271): a, c, t, g, unknown or other
  modified_base (306)..(306): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggngagtcaggttcgtttcggngctgttgcctggtttcaacgaaaaggggngacggcccctaaggtcctcgtctctcgtgaaaccngactggaaggtagacgtcccgtcaggttcagtcgccagtccaggtggtgggccccggtagtcccactcctcgaaccctattcgccgaaccctggccggtcctagaaacgtcttcctgtacctaaactttattttctcgttacaggtctaaggttacttaccgagttacggttccggtacccccggttttactaaccgtttttcgggaccccggttaagggggaacccctaaaggtccgtttaaaggggaaaaccttaccgaaaaaccggtaaacgttggtacggggtaccttcgggacccgtaacccgtaagtttcccttcggtttaacccttttcccgtaacgttttccccctttcccccggaccccttaatttaccccgttacggttaaacttttaaacg

SEQ ID NO: 389196 - DNA, 553 bp, Homo sapiens
  misc_feature: GZ8MTXP02H99P9.44.23.C01.1.454.CMB.2.raw
  modified_base (305)..(305): a, c, t, g, unknown or other
  modified_base (387)..(387): a, c, t, g, unknown or other
  modified_base (443)..(443): a, c, t, g, unknown or other
  modified_base (534)..(534): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggccaggactggtgaggccttcggaacctgtctctcatctgcactgtctctggatttccatcagttctgatcattctggggctggatccggcacgccccgaggacgggaatggagtggatggtgacatccattntacgtggggcgtacgtactactctccgtcctcaacgagtcgtctcgactatttcgagggacacgtccatcgaaccgtcttcncccctagaaactcgacctcgtcgaccgccgcgacacggtcttattctgtgcgtagngagactggtacttcgaatcgttagtcggggtccgtggccacccgttggacctacgtcgtcctccgtcacgtccttccaaccgacggacccncgtccggttcctcccccgg

SEQ ID NO: 389197 - DNA, 547 bp, Homo sapiens
  misc_feature: GZ8MTXP02HL7CW.44.23.C01.1.454.CMB.2.raw
  modified_base (242)..(242): a, c, t, g, unknown or other
  modified_base (271)..(271): a, c, t, g, unknown or other
  modified_base (393)..(393): a, c, t, g, unknown or other
  modified_base (396)..(396): a, c, t, g, unknown or other
  modified_base (435)..(435): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggttcaaacgaaaaggggnaggcccctaaggtcctcgtctctcgtagaaaccagactggaagtagacgtcccgtcaggttcagtgccagtccgaggtggtggccccggagtccactctcaccattgcactgcgcctgaatntcngactaacttattctgtcagcagtatcatagtcgcccttntacgtttggcctaaggggaccaagctaggaaactacgaaaacgactgtcgctagaccaacctatcgtacgtcttacaacgttccttcccgacctaattcctagtacttaacg

SEQ ID NO: 389198 - DNA, 558 bp, Homo sapiens
  misc_feature: GZ8MTXP02HWCW7.44.23.C01.1.454.CMB.2.raw
  modified_base (429)..(429): a, c, t, g, unknown or other
  modified_base (463)..(463): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactgggtgaggccttcgggaaccctgtctctcatctgcactgtctctggagtttccatcagttctgatctattcttggggctggatccggcacgccccgagggagggatggagtggattggtgacatccattatacgtggggcgacgtactactctccgtcctacaacgagtcgtctcaccatttcgagggacaccgtccatcgaaccgctttcctccctagaaacctgaccctcgtgacccgccgcgacncggtcgttattctgtgcgagcgagactggtcttntaatctagtggggcgtgccgtaccgtggtcctacgttcgtctcctcgacgtccgttccaaccgaacgggccctacgtccggttcccttcccccgg

SEQ ID NO: 389199 - DNA, 577 bp, Homo sapiens
  misc_feature: GZ8MTXP02GZ4JQ.44.23.C01.1.454.CMB.2.raw
  modified_base (406)..(406): a, c, t, g, unknown or other
  modified_base (556)..(556): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatgggagtggattggtgacatccattatacgtggggcgacgtactactctccgtcctcaagagtcgtctcaccatttcgaggacacgtccatcgaaccccgtcttcctccctagaaactcgacctccgtcgaccgccgcgacacgtctttattcngtcgcgaggcgagtactggtctttcaattcgtagtggggccgtggcctaccgtggtacactcgtctcctcacgtccttaccgaccgaacggggtcccctagttcccggttcccttcccccgtcggcccgtccccttgacctccgacggcncaccgtcggcggggccaccgg

SEQ ID NO: 389200 - DNA, 540 bp, Homo sapiens
  misc_feature: GZ8MTXP02JFIAG.44.23.C01.1.454.CMB.2.raw
  modified_base (273)..(273): a, c, t, g, unknown or other
  modified_base (399)..(399): a, c, t, g, unknown or other
  modified_base (403)..(403): a, c, t, g, unknown or other
  modified_base (443)..(443): a, c, t, g, unknown or other
  modified_base (530)..(530): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctgggtttacaaacgaaaagggggnaggcccctaaaggtcctcgtctctcgtagaaaccagactggaaggtagagtcccgtcaggttcagtgccagtccaggtggtgggccgagtccactctcaccattacgcgacctgccggcctgaagnttcngctaacttattctgtcagcagtatcatagtcgccccgttntactttggaccagggggaccaagctaggaaacttaaacgactgagctcgacaccatctacgtcttacactcctcccgctactcgtanactatactac

SEQ ID NO: 389201 - DNA, 600 bp, Homo sapiens
  misc_feature: GZ8MTXP02G1E7N.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatggagtggattggtgacatccattatacgtgggcgacgtactactctccgtcctcaagagtcgtctcaccatttcgaggacacgtcatcgaaccccgcttctcctagaaactcgacctccgtcgaccgccgacgacgacggtccgtttacttcgtgtcgcgaggcgagacgtcggtctttcgaatcgtagtcggggtccgttggctaccgtggtcacgtcgtcctccgttcacgtccttccgaccgaacgggccctagttcccgggttcccttcccccgtcgggtcccgtccccgtcgtcccgttcccgaacggtaccgccgacccgttccggtcgggggacccaccggg

SEQ ID NO: 389202 - DNA, 641 bp, Homo sapiens
  misc_feature: GZ8MTXP02GX2SC.44.23.C01.1.454.CMB.2.raw
  modified_base (242)..(242): a, c, t, g, unknown or other
  modified_base (276)..(276): a, c, t, g, unknown or other
  modified_base (457)..(457): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcttgttgccttggtttacaaacgaaaagggggnacggcccctaaggtccctcgtctctcgtagaaaccagactgggaaggtagacgtcccgtcaggttcagtgccagtccgaggtggtgggccccggagtccactctcaccattcgcgactgccgcctagaacgtattctgactaacttattctgtcagcagtatcatacgtcgtaccccgttntacgtttcggaccgtaagggggtacccaaggtcgttaacgggaaaacttaccgaaaaacggtaaccgttgggttacgggaccttacggaccctaaaccgtaacgttccttcggttaccttttaccgaaccgttttccccgtttacccccgtcctaaacgtttcccttaacggtaactttaaacg

SEQ ID NO: 389203 - DNA, 576 bp, Homo sapiens
  misc_feature: GZ8MTXP02H95EB.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcagcccccagggacggggaatgggagtggagttggtgacatccattatactggggcgacgtactactctccgtcctcaacgagtcgtctcacctatttcgaggggacacgtccatcgaaccgcttctccctgaaactgacctccgtcgaccgccgcggacacggtccgtttattcgtgtgcgtaggcgagactggtctttcaatctagtcggggtccgtggtccacccgtggtcctacgttcgtccgtccctcgtacgcctttcccgaacccgtaacggggcccctacgttcccgggtccctttccccccgg

SEQ ID NO: 389204 - DNA, 627 bp, Homo sapiens
  misc_feature: GZ8MTXP02JQ7A1.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcacgccccgagggacgggaatggagtggagttggtgacatccattatacgtgggcgacgtactactctccgtcctcacgagtcgtctcactatttcgagggaccacgtccatacgaaccgtcttcctccctagtaaacctcgaccctcccgtacgacccgtcccgacggaccgtaccgggtccgtttacgtttcgtgttcggccggtacgggcgtacggtaccttcgggttaccttttacgaaacgttcgttacggtcgggggtccgtacgggtcctacccgtgggtccaccgttcgttccctccgtcgtacgtccgttcccgaacccgacgggtcccctagttcccggtccctttcccccgg

SEQ ID NO: 389205 - DNA, 613 bp, Homo sapiens
  misc_feature: GZ8MTXP02HFCLA.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgccccgagggagggaatgggagtggagtggtgacatccattatacgtgggcgacctactacctcctccgtcctcgaagacgtcgtctcacctatttcgaggacacgtcatcgaaccccgtcttcctccagtaaactcgacctccgtcgaccgccgccgaccacggtccgtttattcgtgtcgcgtaggcgagtactcggttctttacgaactcgtaggtcgggtccgtcggtaccgtaccgtcggtaccaccgttcgttccttcccgtctacggtcccttacccgacccgaaaccgggcccctacgttccggtcccttccccgtcggtcccgcccgtcgcctccgacgacgccaccgtcggcggggacaccgg

SEQ ID NO: 389206 - DNA, 546 bp, Homo sapiens
  misc_feature: GZ8MTXP02IVWHL.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggatttccatcagttctgatcattcttggggctggatccggcagcccccgaggaggggaatggagtggattggtgacatccattatacgtggggcgacgtactactctccgtcctcaagacgtcgtctcacctacgtttcgaggggacacgtccatcgaacgtcttctccctagaaactgacctccgtgaccgcccgcggaccacggtccgtttatttctgttgcgtaggcgagactggtctttcaatctatggggcgtcggcacctggtctcgtcgtcctcctcagcttccgacctacgggcccagtccggtctttcccccg

SEQ ID NO: 389207 - DNA, 581 bp, Homo sapiens
  misc_feature: GZ8MTXP02G005U.44.23.C01.1.454.CMB.2.raw
  modified_base (363)..(363): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggaggggaatgggagtggattggtgacatccattagtactggggcgacgtactactctccgtccctcaagacgtcgtctcaccatttcgagggacacgtccatcgaaccccgcttccncctgaaactcgaccctccgtgacccgccgccgacacggtcctttattctgtgcgaggcgagtactggtcttcaatcgtagtcggggccgtggcctaccgtgggtcactcgtcctccgtcacgtccttcccaaccgaacgggccctacgtccgttcccttcccccgtcggcccgcccctcggcctccgacggccgccacccgtcggtcgggggcaccgg

SEQ ID NO: 389208 - DNA, 548 bp, Homo sapiens
  misc_feature: GZ8MTXP02JTKWJ.44.23.C01.1.454.CMB.2.raw
  modified_base (432)..(432): a, c, t, g, unknown or other
  modified_base (453)..(453): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggacggggaatgggagtggagttggtgacatccattatacgtggggcgacgtactactctccgtcctcaacgagtcgtctcacctatttcgagggacacgtccatcgaaccgtcttctccctagaaactcgacctccgtcgaccgccgcgacncggtcctttattcgtgtgcgngcgagactgtcttcatcgtagtcgggcgtggccaccgtggtcacgtcgtcctcctcacgtccttccaccgacggccacgtccggtccttccccgg

SEQ ID NO: 389209 - DNA, 399 bp, Homo sapiens
  misc_feature: GZ8MTXP02GMJ79.44.23.C01.1.454.CMB.2.raw
  modified_base (303)..(303): a, c, t, g, unknown or other
  modified_base (315)..(315): a, c, t, g, unknown or other
  modified_base (322)..(322): a, c, t, g, unknown or other
  modified_base (329)..(329): a, c, t, g, unknown or other
  modified_base (390)..(390): a, c, t, g, unknown or other
  modified_base (392)..(399): a, c, t, g, unknown or other
tcagacagtatatacacgaccggtgctcgatttagtacacgtgattagggattgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactaggtatggacgtctggggaccaagggacccacggtcaccgtctcctcagcttccaccaagggcccatcggtctccccctgcnccctgctcagancactcgngggcacngcgcctggctgccctgtacaaggactacttcctatctactgtctgagcggctgcaggcganannnnnnnn

SEQ ID NO: 389210 - DNA, 592 bp, Homo sapiens
  misc_feature: GZ8MTXP02H0Z9H.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggagggaatggagtggattggtgacatccattatacgtgggcgacgtactactctccgtcctcaagagtcgtctcacctatttcgaggacacgtccatgaaccccgcttcctcctagaaactcgacctccgtcgaccgccgcgacacggtcttttatttccgtgtgcgaggcgagacgttggttctttcaattcgtagtcggggtccgtggcgtacccgtggtccacttcgtctccttcacgtccttccaccaacgggccctagttcccgggtccttcccccgtcggtcccgtccccttcgccctcccgacgggaccgccgacccgtccggtacgggggccaaccgg

SEQ ID NO: 389211 - DNA, 623 bp, Homo sapiens
  misc_feature: GZ8MTXP02JOMXS.44.23.C01.1.454.CMB.2.raw
  modified_base (304)..(304): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgtggggctggactccggcacgccccgagggacgggagtggagtggagttggngacatccattagtacgtgggacgtacgtactactcctccgtcctacaacgtacgtcgtctacctactagtttacgacgggacctacgtaccagtacgaacccgtcttcctacccgtacgaaactcgacctccgtcgacccgccgacggacgtaccggtcctttagttcgtggtcgcggtacgcgtacgtacgttggttcctttacacgttctagggtcgggtccgtcggtccgtaccgttggtcctacgtcgtcctcccgtacgaccgtcctacccgaaccggaccggtaccctacgttcccggttccctttcccccgg

SEQ ID NO: 389212 - DNA, 580 bp, Homo sapiens
  misc_feature: GZ8MTXP02H9PUD.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgtgggctggatccggcacgccccgagggagggatggagtggagtggtgacatccattagtacgtgggcgtacgtactactctccgtcctacaacgagtcgtctacacctagtttcgaggacacgtccagtacgaaccgtcttcctccctagaaactcgacctccgtcgaccgccgcgaccgacggtccgtttattctagtcgacgtagcgagacgttggtctttacaagttcgtagtcggggtcccgtaggtccctacccgttggtacctacgttcgtcctccgtcacgtccttccaaccgacggcccacgtccggtcccttcccccgg

SEQ ID NO: 389213 - DNA, 543 bp, Homo sapiens
  misc_feature: GZ8MTXP02GAHYX.44.23.C01.1.454.CMB.2.raw
  modified_base (361)..(361): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccagggagggaatggagtggattggtgacatccattatactggggcacgtactactctccgtccctcaacgagtcgtctcaccatttcgngggacacgtccatcgaaccgtcttctccctgaaactgaacctcgtgacccgccgcggacacggtccgtttatttctgtgcgaggcgagactggtctttcaatctagtgggggcctggccacccgtggtccacgtgtcctcctcagccttccaccgacgggcccagtccggtcctttcccccg

SEQ ID NO: 389214 - DNA, 601 bp, Homo sapiens
  misc_feature: GZ8MTXP02IUCND.44.23.C01.1.454.CMB.2.raw
  modified_base (574)..(574): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggactccggcacgccccgagggagggaagtgggaggtggagttggtgacatacctattagtacgtggggacgacgtactactcctccgtcctacaacgagtcgtctcacctattcgaggacacgtcatcgaaccccgtcttcctcctagaactcgacctccgtcgaccgccgcgacctacggtcctttattcgtgtcgcgaggcgagtacgtcgttcttacactcgtaggtcggggcgtcggcctaccgtgtctacgtcgtcctcctcgacgtccttaccgaccgacggccctacgtcccgtcccttcccccgtcggcccgtcccgtcgcccgtccgacggacncccgtaccgtcggtcggggacaccggg

SEQ ID NO: 389215 - DNA, 605 bp, Homo sapiens
  misc_feature: GZ8MTXP02FLILV.44.23.C01.1.454.CMB.2.raw
  modified_base (242)..(242): a, c, t, g, unknown or other
  modified_base (273)..(273): a, c, t, g, unknown or other
  modified_base (309)..(309): a, c, t, g, unknown or other
  modified_base (497)..(497): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttacaaacgaaaaggggnacggcccctaaggtccctcgtctctcgtagaaaccngactgggaagtagacgtcccgtcgtaggtcagtcgccagtccgagggtggtggggccccgagtccagtctcacctattacggccgacctggcccgggtcctaggaaacgtactttcgtggaccctaaacttttagtttccgtgttacaacggtactaagttatactattaggtccgtacccccgtttntacgttttcggaccgtaagggggacccaagcgtaggaaactacaaaacgactgtacggctgacaccatctgtccttcaacttccttcccgactactctacgtacttaa

SEQ ID NO: 389216 - DNA, 533 bp, Homo sapiens
  misc_feature: GZ8MTXP02IW5BO.44.23.C01.1.454.CMB.2.raw
  modified_base (298)..(298): a, c, t, g, unknown or other
  modified_base (363)..(363): a, c, t, g, unknown or other
  modified_base (434)..(434): a, c, t, g, unknown or other
  modified_base (456)..(456): a, c, t, g, unknown or other
  modified_base (482)..(482): a, c, t, g, unknown or other
  modified_base (492)..(492): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggngacatccattatacgtggggcgacgtactactctccgtcctcaacgagtcgtctcaccatttcgngggacacgtccatgaaccgcttctccctgaaactgacctccgtgaccgccgcggacacggcctttatttcngtgcgagcgagactggtctttnaatcatggggcgtggcaccctggtcnctcgtctccncacgctcccaccgacgggtcccactccggtcctttcccccg

SEQ ID NO: 389217 - DNA, 569 bp, Homo sapiens
  misc_feature: GZ8MTXP02F9Q3C.44.23.C01.1.454.CMB.2.raw
  modified_base (426)..(426): a, c, t, g, unknown or other
  modified_base (454)..(454): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcagcccccgagggaggggaactgggagtggatttggtgacgatccattatacgtggggcgacgtactactctaccgtccctcaacgagtccgtctcaccatttcgagggacacgtccatcgaaccgtcttcctccctgaaacctgaaccctccgtcgacccnccggcggaccacggtccgtttactttcngttgcggtgcgagactcggtctttacaatctagtcgggcgtggctaccgtggtcacgttcgtcctcctcacgtccttaccgaccgaacgggccctactccggttccttcccccgg

SEQ ID NO: 389218 - DNA, 568 bp, Homo sapiens
  misc_feature: GZ8MTXP02HJV2E.44.23.C01.1.454.CMB.2.raw
  modified_base (240)..(240): a, c, t, g, unknown or other
  modified_base (271)..(271): a, c, t, g, unknown or other
  modified_base (307)..(307): a, c, t, g, unknown or other
  modified_base (412)..(412): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgtttcggngctgttgccttggtttcaacgaaaagggggngacggcccctaaggtcctcgtctctcgtagaaaccngactggaaggtagacgtcccgtcaggttcagtgccagtccagggtggtcggggccggacgtcccactctcaccattagccgacctggccggcctagaagtattcngtctaacttatttctgtcagcagtatactatagttcgccccgttctacgttttcggaccgtacggggaccaagcgtaggaaactacgaaacgtacgtagtcggtctacgcaccgtatctcgtctactactccgttcccgactactctcgtatatac

SEQ ID NO: 389219 - DNA, 626 bp, Homo sapiens
  misc_feature: GZ8MTXP02GHW01.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggaatgggagtggagttggtgacatcattatacgtgggcgacgtactactctccgtcctcaagacgtcgtctcactattcggaggacacgtcatcgaaccccgtcttcctccctagtaaactcgtaaccctccggtacgacccgccggaccggaccgtacggttcccgttttaatttccgtgttcggacgacggcgaagtacgtcggttctttacaattcgtagtcggggccgttggcctaccgtcggtactactcgtcctcctcgacgtccttacccaacgtaacggccctacgtcccggttcccttcccccgcggtccctcccgtcgcccgtccgaacggccgaccgtcccgtcggtcgggggacaacccggg

SEQ ID NO: 389220 - DNA, 575 bp, Homo sapiens
  misc_feature: GZ8MTXP02JWOUB.44.23.C01.1.454.CMB.2.raw
  modified_base (510)..(510): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggattggtgacatccattatacgtgggcgacgtactactctccgtcctcaacgagtcgtctcacctatttcgagggtacacgtccatcgaaccgcttcctccctagaaactcgacctccgtcgacccgccgcgacgaccggtccgtttattctgtgcgaggcgagactggtctttacaattcgtagtcggggtcgtcgggtcctacccgtggtaccncgttcgtcctccttcacgtccttcccgaaccgaccgggccctacggtccggttcccttcccccgg

SEQ ID NO: 389221 - DNA, 612 bp, Homo sapiens
  misc_feature: GZ8MTXP02G5TI6.44.23.C01.1.454.CMB.2.raw
  modified_base (397)..(397): a, c, t, g, unknown or other
  modified_base (410)..(410): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatgggagtggattggtgacatccattatacgtgggcgacgtactactctccgtcctcaagacgtcgtctcacctagtttcgaggacacgtccatcgaaccccgtcttcctccctagaaactcgacctccgtcgaccgccgcgacncggtctttattcngtcgcgaggcgagtacgtggttctttacgaattcgtaggtcggggccgtgggacctaccgtggtcctacgtcgttctccgtcacgtccttaccgaccgtaacgggtccctacgttccggttcccttcccccgtcgggtcccgtcccgtacgtcccgtccggacgggacctccgtacccggtcggtaccgggggccaaccggg

SEQ ID NO: 389222 - DNA, 888 bp, Homo sapiens
  misc_feature: GZ8MTXP02JB1HY.44.23.C01.1.454.CMB.2.raw
  modified_base (239)..(239): a, c, t, g, unknown or other
  modified_base (244)..(244): a, c, t, g, unknown or other
  modified_base (251)..(251): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggttacttcatctnttctntatactnttcggtggtcgtaggcgtccgcgccgcccggaggggaacggtagtggagtaggtgttggagactactactaattacgtacggtgggtaccgtacgtactacctccgtcccgtccctacgaacgtcgttccgtctcctaccttagttacgggacgggtacctaccggtacctagtaccgtaacccgttcccgtttacccgtaccccgttaaacgtaaaacccggttcccgtaacccccgtttcccgggtacccggtaaccccccgggtccccggggaaccccgggtaaaccccggttaccccggggttttaaacccgttttttaccgttttaccgggttacgggtttccggggaaccggggttaccgggggacccgggttaaacggggtttacccggtttccgggtttttaccctttaaaccggtaaaccgttttacccgggttagggggttcccggggggttacccgggttcccgggtaacccccggttacccgggtttaccgggtacccttaccggtttccggttaccccttcccgtaccggttaaccgttcccccgttaacccccggaaaccgggtaaacccggggtacccccttaccggtttcccccggggtttaccccctttccccccggggg

SEQ ID NO: 389223 - DNA, 662 bp, Homo sapiens
  misc_feature: GZ8MTXP02IQHII.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatctattcgttgggctggatccggcacgccccgagggagggaagtgggagtggagttggtgacatacctattatacgtggggacgacgtacctactctccgtcctacaagacgtccgtctacacctacgtttcgagggaccacgtccaagtcgaaccccgtcttacctccctagaacctcgacctccgtcgaccgccgacgaccgacggtcctttattcgtgtcgcgagcggaagtacgttcggtctttacaaattccgtaggtcggggccgttcggacccgtacccgttgggtacctaccgttcgttccctccttcgacgtacccttaccccgaaacggtaacccgggccccttacggtccccggttccgttccccccgtggtccccgaccccttcggccctaacccggaacggccgacccaccggttcggtaccgggggaccaacccggg

SEQ ID NO: 389224 - DNA, 560 bp, Homo sapiens
  misc_feature: GZ8MTXP02FIIIK.44.23.C01.1.454.CMB.2.raw
  modified_base (239)..(239): a, c, t, g, unknown or other
  modified_base (271)..(271): a, c, t, g, unknown or other
  modified_base (306)..(306): a, c, t, g, unknown or other
  modified_base (444)..(444): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgttttcggngctgttgccttggttacaaacgaaaagggggnacggcccctaaaggtcctcgtctctcgtgaaaccngactggaaggtagagtcccgtcaggttcagtgccagtccaggtggtgggccggagtccactctcaccattagcgacctgcggcctgaagattctgctaaacttatttctgtcagcagtatcatagtcgtcccccgttntacgttttggcccgtagggggaccaaagcctaggaaaactacgaaaacgaacgtgtaggctgactaccattcctacgttccttcacttccttcccgcctactctagaacttataac

SEQ ID NO: 389225 - DNA, 586 bp, Homo sapiens
  misc_feature: GZ8MTXP02H7MBP.44.23.C01.1.454.CMB.2.raw
  modified_base (438)..(438): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctagtttcgtggggctggatccggcacgcccccgagggacggggaagtggagtggagttggtgacatccatatacgtggggcgacgtactactcctccgtccctcaacgacgtcgtctcactatttcgacgactacgtccatcgaccgtcttcctccctagaaactcgaccctcgtcgaccgccgcggacnccggtcttattctgtcgcgagcgagacgtggtcttacaatcgtagtcgggtcgtcgtccgacccgttggtacctcgtcgttcctcctaccgtcgtcccttaccgaaccgtaccgggacccctacgttccccggttccttccccccggg

SEQ ID NO: 389226 - DNA, 584 bp, Homo sapiens
  misc_feature: GZ8MTXP02FR1U0.44.23.C01.1.454.CMB.2.raw
  modified_base (241)..(241): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttcngatcattcttgggctggatccggcacgcccccgagggagggaatggagtggagttggtgacatccattatacgtggggcacgtactactctccgtcctcaacgagtcgtctcactatttcgagggacacgtccatcgaaccgtcttctccctagaaacctcgacctccgtacgacccgccgtacggacgtcggtccgtttattcgtgtcgcgaggcgaagtcgtaggttctttacaacgttcgtagtcgggggtccgtcgggacctacccgtggtccacgttcgtcctcctctacgtccttacccgaccgtaacgggccctacgtccggtccctttcccccgg

SEQ ID NO: 389227 - DNA, 565 bp, Homo sapiens
  misc_feature: GZ8MTXP02IDSP0.44.23.C01.1.454.CMB.2.raw
  modified_base (432)..(432): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcttggggctggatccggcacgcccccgagggaggggaagtggagtggattggtgacatccattatacgtggggacgacgttactactctcccgtcctcaacgagtcgtctcacctatttcgagggacacgtccatcgaaccgcttctccctgaaactcgacctccgtcgaccgccgcgacncgtcttattctgtcgcgtaggcagacttggtctttacaatctagtcggggtccgtggcctacccgtggtctacgtcgttcctccttcacgtccttccaccgtaacgggccctacgttcggtcccttcccccgg

SEQ ID NO: 389228 - DNA, 577 bp, Homo sapiens
  misc_feature: GZ8MTXP02IWPEM.44.23.C01.1.454.CMB.2.raw
  modified_base (258)..(258): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggagggaatggagnggttatggtgacatccattatactggggcgacctactactctccgtcctcagagtcgtctcacctatttcgagggacacgtccatcgaaccccgtcttctccctagaaactcgacctccgtcgacccgccgcgacacggtccgtttattctgtgcgaggcgagactggtctttcaatctagtggggccgtgcaccgtggtcactcgtctcctcgacgtccttaccaccgaacgggccctagttccggtccgtttcccccgtcggtccgtcccctcgtcctcccgaacggacgccgacccgtcggtcgggggccaaccgg

SEQ ID NO: 389229 - DNA, 574 bp, Homo sapiens
  misc_feature: GZ8MTXP02HDGK8.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatgggagtggattggtgacatccattagtacgtggggcgacgtactactctccgtcctcaagacgtcgtctcacctatttcggaggacacgtcatcgaaccccgcttctcctagaactgacctccgtgaccgccgcgacacggtcgtttattctgtgcgaggcgagacgtggtcttcgaattcgtagtcggggccgtggcctaccgtgggtcactcgtcctcctcacgtccttaccgacgaacgggccctacgtccggtcccttccccgtcggcccgtccctcgcctccggacgacgtccgaccgtccggcggggccaccgg

SEQ ID NO: 389230 - DNA, 740 bp, Homo sapiens
  misc_feature: GZ8MTXP02IF8MX.44.23.C01.1.454.CMB.2.raw
  modified_base (242)..(242): a, c, t, g, unknown or other
  modified_base (277)..(277): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngtctgttgccttggtttacaaacgaaaaggggganacgggcccctaaaggtcctcgtctcgtcgtagaaaccagactgggaagtgacgtcccgtcaggtcagtgccagtccaggtggtcggccccgagtccactctacaccattacgccgtaacctcggtccggccctaggaaacgtactttccgtaggacccttaaaacgtttacttttcgttaggttacctaaggtcctaaggttacttactacgtttaaaccgtttaccccccggttttacttaaccgttttttcggggaccccgtaaaggggggtaacccctaaagggtaccttaaggggtaaaacttaccggaaaaaccggtaacgttacgggtacggtaccgtacggtacccgtaaacccttaacttaccgtttacggttcccttttaccctaacgtttaaccccgtttcccccggtaaccgttaaacgttcccgtttacgttaaactttaactttaaaccg

SEQ ID NO: 389231 - DNA, 580 bp, Homo sapiens
  misc_feature: GZ8MTXP02JZMDS.44.23.C01.1.454.CMB.2.raw
  modified_base (324)..(324): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggatggagtggagttggtgacatccattatacgtgggcgacgtactactctccgtcctcagacgtcgtctcacctntttcgaggacaccgtccatcgaaccccgcttcctcctagaactcgacctccgtcgacccgccgcgaccacggtcctttattcgtgtgcgaggcgagactcggtcttcatctagtgggccgtggcaccgtgtccacgtcgtcctcctcgacgtccttccgaccgaacgggccctacgtcccggtcccgttcccccgtcggcccgtccccgtcgcccgtccgacggacgcccgacccgttcggtcgggggcacccggg

SEQ ID NO: 389232 - DNA, 544 bp, Homo sapiens
  misc_feature: GZ8MTXP02HFC73.44.23.C01.1.454.CMB.2.raw
  modified_base (245)..(245): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggngggaatggagtggatggtgacatccattatactgggcgacgtactactctccgtccctcaagagtcgtctcaccatttcgaggacacgtccatcgaaccccgcttctccctagaactcgacctccgtgaccgccgcgacacggccgtttattctgtgcgaggcgagactggtcttcgaatctagtgggccgtggctacctggtcactgtctctcacgtcttccaccgaacggcccactccggtcccttccccgtcgcccgtcctcgcctccgacggcgccacctcgtcggggcacccgg

SEQ ID NO: 389233 - DNA, 634 bp, Homo sapiens
  misc_feature: GZ8MTXP02FSS3N.44.23.C01.1.454.CMB.2.raw
  modified_base (242)..(242): a, c, t, g, unknown or other
  modified_base (280)..(280): a, c, t, g, unknown or other
  modified_base (282)..(282): a, c, t, g, unknown or other
  modified_base (284)..(284): a, c, t, g, unknown or other
  modified_base (290)..(290): a, c, t, g, unknown or other
  modified_base (293)..(293): a, c, t, g, unknown or other
  modified_base (305)..(305): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttcngatcattctgggctggatcgcagccccgaggggagagngngngtgtgnganctatatactggnggacgtactactctcctcctcctagacgtcgtcgtctacctacttacgtacggcgacgtccgtactacgtaccgtacctccttccctaccgtaaacgtacgtaccgtaccctcggtacccgacccgcccggaccgaccggtaccgttacgtttcttcgtcgtacggacggtcggacgtaacggttcggttccgtttcgtaactacgtttacgtcggggtccgggtcgggtccgtaacccgtcggttcgtaacctggttccttccctacctacgtccgtccgtacccgaaacggacccggtacctcggttccccgttccccgtttcccgg

SEQ ID NO: 389234 - DNA, 592 bp, Homo sapiens
  misc_feature: GZ8MTXP02HKNB3.44.23.C01.1.454.CMB.2.raw
  modified_base (372)..(372): a, c, t, g, unknown or other
  modified_base (406)..(406): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggatccggcacggcccccgagggaggggaatgggagtggattggtgacatccattatacgtgggacgtacgtactactcctccgtcctcaacgtagtcgtctcactagtttcgngggactacgtccactagaccgtcttcctccctanaaacctcgacctccgtgacccgccgcgaccacggtcgtttacttcgtgttacggcgaggcgaggtactcggttacttacgtaacttcgtaggtcggggcgtcggccgtacccgtggtccacttcgtcctcctccgacgtccttcccgaaccgtaaccggcctaccgtccggttccctttcccccgg

SEQ ID NO: 389235 - DNA, 585 bp, Homo sapiens
  misc_feature: GZ8MTXP02ID5RQ.44.23.C01.1.454.CMB.2.raw
  modified_base (530)..(530): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaccctgtctctcatctgcactgtctctggagtttccatctagttctgatcattcttggggctggatccggcagcccccgagggacgggatggagtggatggtgacatccattatacgtgggcgacgtactactctccgtccctcacgagtccgtctcacctatttcgaggggacacggtccagtcgaacccgcttcctccctgaaacctcgacctccgtcgacccgccgcggacacggtccgtttattcgtgtcgcgtaggcgagactggtactttcaatcgttagtcgggggtccgtggccacccgttggtcctacgtcgttcctcccttacncgtccttacccgaccgaacggggcccctacgtcccgggttaccctttccccccgg

SEQ ID NO: 389236 - DNA, 609 bp, Homo sapiens
  misc_feature: GZ8MTXP02JR1GJ.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaatggagtggattggtgacatccattatacgtgggcgacgtactactctccgtcctcaagacgtcgtctcacctatttcggaggacacgtccatcgaaccccgcttcctcctagaacctcgacctccgtcgaccgccgacggaccgaccggtccgttttatttcgtgttcgcgaggcgagtactggttctttacaattcgtagtcgggggtccgtaggcctacccgtgggtcctacgttcgtcctccgttcgacgtccttacccgaccgacgggtccctacgttccggtcccttccccgtcggcccgtcccgtcgccctccgacggaccgtccgacccgttcggcgggggccaccgg

SEQ ID NO: 389237 - DNA, 538 bp, Homo sapiens
  misc_feature: GZ8MTXP02J2A3D.44.23.C01.1.454.CMB.2.raw
  modified_base (240)..(240): a, c, t, g, unknown or other
  modified_base (268)..(268): a, c, t, g, unknown or other
  modified_base (394)..(394): a, c, t, g, unknown or other
  modified_base (438)..(438): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaacaaaaggggnaggcccctaaggtcctcgcctctcgtgaaaccagactggaaggtagagtcccgtcaggttcagtgccagtccgaggtggtgggccccggagtccacgtctcaccattgcgacctgcgcctgaaagnttctgctaacttattctgtcagcagtatcatacgtgccccgttnacgttttcggccgtagggggaccaaggctaggaaactcgaaaacgaactgtacggctgcaccagtctcgtcttcaacttccttcccgctatcctgattac

SEQ ID NO: 389238 - DNA, 600 bp, Homo sapiens
  misc_feature: GZ8MTXP02GTCZR.44.23.C01.1.454.CMB.2.raw
  modified_base (369)..(369): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatgggagtggattggtgacatccattatacgtggggcgacgtactactctccgtcctcaacgagtcgtctcacctagtttcgngggacacgtccatcgaaccgcttcctccctagaaacctgacctccgtgacccgccgcggaccacggtccgtttactttcgtggttagcggaggcgagtactggttcctttcgaattcgtagtcggggccgtcggtccgtacccgtgggtcctacgttcgtccctccgtctacgtcccttacccgaaccgaaccgggtcccctaacgttccccgggttacctttccccccgg

SEQ ID NO: 389239 - DNA, 593 bp, Homo sapiens
  misc_feature: GZ8MTXP02HP5J3.44.23.C01.1.454.CMB.2.raw
  modified_base (398)..(398): a, c, t, g, unknown or other
  modified_base (568)..(568): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcatttcttggggctggatccggcacgccccgagggaggggatggagtggattggtgacgatccattatacgtggggcgacgtactactcctccgtcctcaagacgtcgtctcacctatttcgaggacacgtccagtcgaacccgcttcctccctagaactcgacctccgtcgaccgccgcgaccncggccgtttattcctgtcgtcgaggcgagtactggttctttcgaattctagtggggccgtggctacccgtggccactgtcctctcagtccttaccgaccgaacgggtcccagttcccggttccctttcccccgaggcccccgtcccttcggacctaacccgagggacccnccgtaccgtccggcggggaccacgg

SEQ ID NO: 389240 - DNA, 570 bp, Homo sapiens
  misc_feature: GZ8MTXP02JSWVT.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatggagtggattggtgacagtccattatactggggcgacgtactactctccgtcctcaagagtcgtctcaccatttcgaggacacgtccatgaaccccgcttctccctgaactcgacctccgtcgaccgccgcgacacggcctttattctgtgcgaggcgagactggtctttcaatctagtggggcctggcacctgggtcacgtgtcctcctcagtccttccaccgaacggggccccagttcccggtcctttcccccggcggtcccgcccgtccgtcgtaacccgtacggaacgccgtacccgtccggtcggggtacgaccg

SEQ ID NO: 389241 - DNA, 587 bp, Homo sapiens
  misc_feature: GZ8MTXP02IV5FK.44.23.C01.1.454.CMB.2.raw
  modified_base (543)..(543): a, c, t, g, unknown or other
  modified_base (549)..(549): a, c, t, g, unknown or other
  modified_base (565)..(565): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacggcccccgagggacggggaagtgggagtggagttggtgacatccattatacgtggggcgacgtactactctccgtcctcaagacgtcgtctcacctatttcgaggacacgtcatcgaacccgtctcctcctagaactcgaccctccgtcgacccgccgaccggaccacggtccgttttacttcgtgtcgcgaggcgagtacgttggttcttcaatcgtagtcggggcctggcctaccgttggtccacgttcgtcctcctcgacgtccttaccgaccgacgggccctagtccggtccttccccgnggtccncctcgcctccgaggcnccaccgtcggtcggggacacgg

SEQ ID NO: 389242 - DNA, 610 bp, Homo sapiens
  misc_feature: GZ8MTXP02HB8AT.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaagtggagtggattggtgacatccattatacgtgggcgacgtactactcctccgtccctacagcgtcgtctcacctatttcgaggaccacgtccatcgaaccccgtcttctccctagaactcgacctccgtcgaccgccgcgactaccggtccgtttattccgtgtcgcgtaggacgagtacgttcggttctttacgaacgttcgtaggttcggggccgttcgggccctaccgtcggtctaccttgtcctcctcacgtccttaccacgaacggccctagtcccggttccctccccggtcggcccgtcccgtcgcccgtaaccgacggtaccgtcctacccgtcggtcggggacacccggg

SEQ ID NO: 389243 - DNA, 585 bp, Homo sapiens
  misc_feature: GZ8MTXP02GCXSF.44.23.C01.1.454.CMB.2.raw
  modified_base (325)..(325): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggaatggagtggattggtgacagtccattatacgtggggcgacgtactactctccgtcctcaagagtcgtctcacctntttcgagggacacgtccatcgaacccgtcttcctcctagaaactcgacctccgtcgaccgccgacgaccacggtccgtttattctgtcgcgaggcgagacgtggtcttcaatcgtagtcggggccgtggcctaccgtggtcctacgtcgtctcctcgacgccttacccgacaacgggtcccacgttccggtcccttccccgtcggcccgtccccgtcgccgtcccgacggaccgccgaccgtcggtcgggggaccaccgg

SEQ ID NO: 389244 - DNA, 570 bp, Homo sapiens
  misc_feature: GZ8MTXP02GANEW.44.23.C01.1.454.CMB.2.raw
  modified_base (240)..(240): a, c, t, g, unknown or other
  modified_base (269)..(269): a, c, t, g, unknown or other
  modified_base (421)..(421): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgtttcggngctgttgcctggttacaacgaaaaggggngacggcccctaaggtcctcgtctctcgtagaaaccagacgtagggaaggtagacgtcccgtcaggttcagtcgccagtccgaggtggtgggccccggagtccactctcacctattcgcgacctggccgctagaacgtattcagctaactttnttcgtgtcagctagtatctatacgtcgcccgttactacgtttcggaccgagggaccagtcgtaggaaactacgaaacgtacgtgtacggctgacctacctattcctcgtacttctaacttcccttacccgctacttctacgtactttaa

SEQ ID NO: 389245 - DNA, 592 bp, Homo sapiens
  misc_feature: GZ8MTXP02HVW3O.44.23.C01.1.454.CMB.2.raw
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcacgcccccgagggaggggaatggagtggattggtgacatccattatacgtggggcgacgtactactctaccgtcctacaacgagtccgtctcacctatttcgaggggacacggtccagttacgaacccgtctttccctccctagaaaaccgtcgaacctcccgtgacccgccgcggacgccggtccgtttattcgtgtgcggtaggcgagacgttggtcctttacaaatcttaagtcggggtccgttggcctacccgtggtccacgttcgtcttcctcgacgtccttaccgacgtaacggccctacgtccggttcccttcccccgg

SEQ ID NO: 389246 - DNA, 558 bp, Homo sapiens
  misc_feature: GZ8MTXP02JEKSF.44.23.C01.1.454.CMB.2.raw
  modified_base (239)..(239): a, c, t, g, unknown or other
  modified_base (271)..(271): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngctgttgccttggttacaaacgaaaagggggnacggcccctaaggtcctcgtctctcgtagaaaccagacgtggaaggtagacgtcccgtcaggttcaggtgccagtccgaggggtggtcggggccggacgtcccacgtctacacctagttacgccgacctggccggtcctagaacgtattctgactaactttattctgtcagcagtatcatagtcgtcccgttctactttcggccgtaggggaccagctaggaaactacgaaacgactgtacgctacgcacatctcgtctcactcctcccgctactctagtactatac

SEQ ID NO: 389247 - DNA, 591 bp, Homo sapiens
  misc_feature: GZ8MTXP02ICE3F.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcatttcgttggggctggatccggcacgccccgagggagggatggagtggagttggtgacatccattatacgtggggcgacgtactactctccgtcctcagacgtcgtctcacctatttcgaggacacgtccatcgaaccccgtcttctccctagaaactcgaccctcgtcgaccgccgcgacacggtctttattctgcgcgaggcgagtcgtggttctttacgaacttcgtagtcggggtaccgttcggacctacccgttgggtcacgttcgtctcctcacgtccttaccgaccgacgggtcccagtcccggtccttcccccgtcggcccgcccgttgcccgtccgaacggcctccgccgtcggtcggggccaccgg

SEQ ID NO: 389248 - DNA, 557 bp, Homo sapiens
  misc_feature: GZ8MTXP02H8QDX.44.23.C01.1.454.CMB.2.raw
  modified_base (398)..(398): a, c, t, g, unknown or other
  modified_base (484)..(484): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggacctgtctctcatctgcactgtctctggatttccatcagttctgatcattcttggggctggatccggcagcccccgagggacggggaatgggagtggattgggtgacgatccattatacgtggggcgacgtactactctccgtcctacacgtacgtccgtctcacctatttcgaggggacacgtccattcgaaccgcttcnccctgaaactgaacctccgtgaccgccggacggaccacggtccgtttattctgttgccgtaggccgagtactggtcttcatctagngggcgtggcaccgtggcacgtcgtctccttcacgtccttccaccgtaacggcccacgtccgtcctttcccccg

SEQ ID NO: 389249 - DNA, 559 bp, Homo sapiens
  misc_feature: GZ8MTXP02FHLD8.44.23.C01.1.454.CMB.2.raw
  modified_base (357)..(357): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccagggaggggaatgggagtggattggtgacatccattatacgtggggcgacgtactactctccgtcctcaagagtcgtctcaccattcgagggacacgtcatgaaccccgcttcncctgaaactgacctccgtcgaccgccgcgacacggtcctttatttctgtgcgaggcgagactggtcttcatctagtggggccgtggcaccgtgtccactcgtctcctcacgccttaccaccaacggggccctacgtccggtcccttcccccgtcggcccgtcccctcgcctccgacggacgccaccgtcgcgggggcaccgg

SEQ ID NO: 389250 - DNA, 580 bp, Homo sapiens
  misc_feature: GZ8MTXP02I1BDO.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaatggagtggattggtgacatccattatacgtggggcgacgtactactctccgtcctcagacgtcgtctcacctatttcgagggtacacgtcatcgaaccccgcttcctccctagaaactcgacctccgtcgacccgccgccgacacggtcctttattctgtgcgaggcgagctggtcttcaatcgtagtcggggccgttcggcctaccgtggtcctacgtcgtctcctcacgtccttaccacgacggccctacgttccggtccttccccgtcggcccgtccctcgcccgtccgacggtcgccgtacccgtcggtcgggggaccacgg

SEQ ID NO: 389251 - DNA, 566 bp, Homo sapiens
  misc_feature: GZ8MTXP02HI5GL.44.23.C01.1.454.CMB.2.raw
  modified_base (524)..(524): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcacgcccccgaggggacgggaagtgggagtggattggtgacatccattagtacgtggggcgacgtactactctccgtcctcaacgtagtcgtctcactatttcgagggaccacgtccatcgaaaccgcttcctccctagaaacctgaccctccgtcgacccgcgcgactacggtccgtttattctgtcgcgtagacgagtacgtggtctttcaatctagtgggcgtcggcctacccgtggtccacgttcgtcctccgtnacgtccttcaaccgtacggccctacgtccggtccttcccccg

SEQ ID NO: 389252 - DNA, 544 bp, Homo sapiens
  misc_feature: GZ8MTXP02JX3RL.44.23.C01.1.454.CMB.2.raw
  modified_base (241)..(241): a, c, t, g, unknown or other
  modified_base (272)..(272): a, c, t, g, unknown or other
  modified_base (399)..(399): a, c, t, g, unknown or other
  modified_base (403)..(403): a, c, t, g, unknown or other
  modified_base (447)..(447): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttacaacgaaaaaggggngacggcccctaaggtcctcgtctctcgtgaaaccagactggaaggtagagtcccgtcaggttcagtgccagtccgaggtggtggccccggagtctactctcaccattcgcgacctgcgcctgaaagnttcngactaactttatttctgtcagcagtatcatagtcgtccccgttntacgtttggccgtaggggaccaagctaggaaactcaaacgactgtcggctgcacactctacgtcttacgaacttccttcccgctactcgtacactta

SEQ ID NO: 389253 - DNA, 585 bp, Homo sapiens
  misc_feature: GZ8MTXP02HYJQH.44.23.C01.1.454.CMB.2.raw
  modified_base (374)..(374): a, c, t, g, unknown or other
tcagacagtatatacacgaccggtgctcgatttagtacacgtgattagggattggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccaggggacggggaagtggaggtggagttggtgacgatccattatacgtggggcgacgtactactctccgtccccctcaagtagtcgtctcgacctntttcgagggacacgtccatgaacccgtcttcctccctgaaactcgaccctcgtcgaccgccgcggaccacggtccgttttatttcgtgttcgcggtagggcgagacgtcgggttctttcaattctagtcggggccgtggcctacccgtggttccacgttcgtcctcctcgacgtccttacccgaccgtaacgggcccctacgtttccccgg

SEQ ID NO: 389254 - DNA, 585 bp, Homo sapiens
  misc_feature: GZ8MTXP02H7K0B.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggatggagtggattggtgacatccattatacgtgggcgacgtactactctccgtcctcaagagtcgtctcacctatttcgaggacacgtccatcgaaccccgtcttcctaccctagaaactgacctccgtcgaccgccgcgacacggtctttattcgtgtgcgtaggcgagacttggtctttcaatctagtcggggccgtggctaccgtgggtccacgttcgtcctccttcacgtcttcccaacgtaaaccgggccctaagttcccggttcccttcccccgtcggcccgcccgttcgccgtccgacggaacgccaaccgtcggtcgggggacaccgg

SEQ ID NO: 389255 - DNA, 625 bp, Homo sapiens
  misc_feature: GZ8MTXP02F86MX.44.23.C01.1.454.CMB.2.raw
  modified_base (295)..(295): a, c, t, g, unknown or other
  modified_base (344)..(344): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcttggggctggatccggcacgccccgagggagggaatgggagtggngttggtgacatccattatacgtggggcgacgtactactctccgtccctnaacgtagtcgtctctactactttcggacgggaccacggtaccagtccgaaaccgtcttcctccctagaaacctcgaccctccgtcgacccgccgacggaccgtacggtaccgtttattcgtgtcgcggacggcgagtacgttcggttcctttacgaagtttcctaggtcgggggtcccgttggggtccctacccgttgggtccctacgtcgttcccttaccgtcaccggtcctacccgtaaccgaaaccgggtccctacgttccggtccctttcccccggg

SEQ ID NO: 389256 - DNA, 571 bp, Homo sapiens
  misc_feature: GZ8MTXP02F7HIP.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttgggctggatccggcacgcccccgagggaggggaatggagtggattggtgactatccattatacgtgggcgacgtactactctccgtcctcaacgagtcgtctcactatttcgagggacacgtcatgaacccgcttcctccctgaaacctgacctccgtcgacccgcccgacggaccgacggtaccgtttactttcgtgtcgcgtaggcgaggacttcggtctttcaagttctagtcggggccgtcgggtctacccgtggtcactcgtcctcctcacgtccttaccaccgacgggccctacgtcccggtctttcccccg

SEQ ID NO: 389257 - DNA, 580 bp, Homo sapiens
  misc_feature: GZ8MTXP02F7M81.44.23.C01.1.454.CMB.2.raw
  modified_base (241)..(241): a, c, t, g, unknown or other
  modified_base (272)..(272): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngtctgttgcctggtttacaacgaaaaggggngacggcccctaaggtcctcgtctctcgtagaaaccagactggaaggtagacgtcccgtcaggttcagtcgcagtccgaggtggtgggcccggagtccactcctcaccattcgcgaccgtgccggcctagaaagtacttcgtgtactaactttatttctgttacagtctagtatcaattacgtcgtccccgtttctacgtttcggacccgtaggggacccaggacgtaggaaactacgaaaacgtacgtagtcggactcgacacacttcacgttctacaacttccgttcccgactactctactattaac

SEQ ID NO: 389258 - DNA, 565 bp, Homo sapiens
  misc_feature: GZ8MTXP02HYFSA.44.23.C01.1.454.CMB.2.raw
  modified_base (523)..(523): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctgggcttggatccggcagcccccgagggacgggaatggagtggattggtgacatccattagtacgtggggcgtacgtactactctcccgtcctcaacgagtccgtctcactatttcgagggacacgtccatacgaaccgtctttacctccctagaaacctcgaaccctccgtacgacccgcccgcggacacggtccgtttattcgtgtgcgtagcgagacctggtcttcaatctagtcgggccgtggccaccgtggtcacgttcgtcctaccncacgtccttccaacgaacggccacgttccggttcctccccgg

SEQ ID NO: 389259 - DNA, 550 bp, Homo sapiens
  misc_feature: GZ8MTXP02J2YQ3.44.23.C01.1.454.CMB.2.raw
  modified_base (514)..(514): a, c, t, g, unknown or other
  modified_base (532)..(532): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcggcccaggactggtgaggcctttcgggaaccctgtctctcatctgcactgtctctggagtttccatcagttctgatcattcttgggctggatccggcagccccagggagggaatggagtggattggtgacagtccattatactgggcgacgtactactctccgtcctcaagagtcgtctcaccatttcgaggacacgtccatcgaaccccgcttctccctagaaactcgacctccgtgaccgcgcgacacggtcgtttatctgtgcgaggccgagactggtctttcaaacttctagtcgggggccgttggccacccgtgtccgtactcgtcctcctcaggccttaccaccgaggcccagtccgtcttccccctggccnccctcgacctccgaggcncgacctcgacggggcacg

SEQ ID NO: 389260 - DNA, 524 bp, Homo sapiens
  misc_feature: GZ8MTXP02GXRQ3.44.23.C01.1.454.CMB.2.raw
  modified_base (240)..(240): a, c, t, g, unknown or other
  modified_base (272)..(272): a, c, t, g, unknown or other
  modified_base (402)..(402): a, c, t, g, unknown or other
  modified_base (444)..(444): a, c, t, g, unknown or other
  modified_base (506)..(506): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaaacgaaaaagggggnaggcccctaaaggtcctcgtctctcgtagaaaccagactggaaggtagagtcccgtcaggttcagtgccagtccaggtggtggcccggagtccactctcaccattcgcaacctgccgcctgaaagattcngactaattattctgtcagctagtatcatagtcgtccccgttnacgtttggaccgaggggaccaagctagaaactcaaaacgactgtgactgcacatctctctcnctcctccacatctatata

SEQ ID NO: 389261 - DNA, 672 bp, Homo sapiens
  misc_feature: GZ8MTXP02I72A0.44.23.C01.1.454.CMB.2.raw
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggaagtgggagtggagttggtgacatccattatacgtgggcgacgtactactcctccgtcctacaagacgtcgtctcacctagtttcgagggaccacgtaccatcgaaccccgtcttcctccctagaacctcgaccctccgtcgacccggccgaccgaccaccggtccgttttacttcgagtcgacggtacggcgagtacgttcgggttactttacaaagttccgtaagtccgggggccttggaccctcccgtaggtcctactcgtcctccgtacacgtccttacccgaccgtaacgggtcccctacgtttcccggtccccgtttccccccgtcgggtcccccgtcccccgtttcggccccttaacccggacggtacccgacccgtaaccccgtttccgggaccgggggaacctaacccggg

SEQ ID NO: 389262 - DNA, 565 bp, Homo sapiens
  misc_feature: GZ8MTXP02JNOMH.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatgggagtggagttggtgacatccattatacgtggggcgacgtactactctccgtcctcaagagtcgtctcacctatttcggagggacacgtccatcgaaccccgcttcctccctagaactcgaccctccgtcgaccgccgcgacacggtcctttattcgtgtcgcgaggcgacgacttggtctttcaatctagtcggggccgtgccacctggtcacgtcgtcctcctcacgtcctccacgaacggcccagtccgtcctccccgtcggcccgcccgtcgcctccgacggacgccaccgtcgtcggggcaccgg

SEQ ID NO: 389263 - DNA, 599 bp, Homo sapiens
  misc_feature: GZ8MTXP02FRN6A.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggactccggcacgcccccgagggagggaagtggagtggagttggtgacatccattatacgtggggcgtacgtactactctccgtccctcaacgacgtcgtctcacctagttcgagggacacgtccatcgaaccgtcttctccctagaaacctcgacccttccgtcgacccgccggtaccggaccgtacgggtaccgtttagtttcctggtgcggaggcgagtacgtcggttctttacgattcgtagtggggtcccgttggccgtacccgtggtcctacgttcgtccttccgtctacgtccttacccgacgaacgggccctagtccggttcctttcccccgg

SEQ ID NO: 389264 - DNA, 548 bp, Homo sapiens
  misc_feature: GZ8MTXP02G3K77.44.23.C01.1.454.CMB.2.raw
  modified_base (302)..(302): a, c, t, g, unknown or other
  modified_base (390)..(390): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacgggaagtggagtggattggngacatcatatacgtgggcgacgtactactctccgtccctcaacgacgtcgtctcactattcgagggcacgtccatcgaaccgcttccnccctagaactcgacctccgtgacccgccgcgacacggtcgtttattctgtgcgaggcgagactggtcttcatctagtcgggctaggcacccgtggtccacgtcgtcctcctcacgccttaccaacccgacgggccctacgtcccggtccttcccccgg

SEQ ID NO: 389265 - DNA, 579 bp, Homo sapiens
  misc_feature: GZ8MTXP02JHFVU.44.23.C01.1.454.CMB.2.raw
  modified_base (306)..(306): a, c, t, g, unknown or other
  modified_base (447)..(447): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgagggagggaagtgggagtggagttggngacatccattagtacgtgggcgacgtactactctccgtcctcaacgacgtcgtctcacctagttcgacgggacacgtccatcgaaccgtcttcctccctagaaactcgacctcgtcgaccgccgcgacgacgtcttattcngtcgcgaggcgagacttggtctttacaagttcgtaacggtcggggccgtcggccctacccgtggtccacgttcggtcctccgtcacgtcctacccaaccgaacgggtcccacgttcccggtccttcccccgg

SEQ ID NO: 389266 - DNA, 666 bp, Homo sapiens
  misc_feature: GZ8MTXP02HVXU0.44.23.C01.1.454.CMB.2.raw
  modified_base (285)..(285): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggaggggaatggaggtggattggtgacatccattatacgngggcgacgtactactctccgtcctcaagacgtcgtctcactatttcggacggacacgtccatcgaaccccgtcttcctccctagaaactcgacctccgtcgaccgccgacggacaccggtccgtttactttcgtagtcggcgacggcggagtaccgttgggttactttacgaaacttcgtaagtcggggtccgttggccgtacccgtgggtccacgtgtcctcctacgtacgtccttcccgaaacccgtaaccgggtcccctaacgttcccgggttcccctttcccccccggtcgggcccccgtacccccgttcgacccgttcccgacgggtaaaccgcccgtaaccccggtttccgggtacgggggtaacccaacccggg

SEQ ID NO: 389267 - DNA, 556 bp, Homo sapiens
  misc_feature: GZ8MTXP02FXLNY.44.23.C01.1.454.CMB.2.raw
  modified_base (270)..(270): a, c, t, g, unknown or other
  modified_base (386)..(386): a, c, t, g, unknown or other
  modified_base (389)..(390): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaaacgaaaaggggnaggacccctaaggtcctcgtctctcgtgaaaccagactgggaagtagagtcccgtcaggttcagtgccagtccaggtggtggcccgagtccatctcaccatgcgactgcgctgagntcnncaacttattctgtcagcagtatcattagtcgtcccgttctacgttttcggaccgaggggtacccaaaggtctacggaaaactcgaaaaccgtaacgtggtacggacttagacctaacctatccgttcgtcctttcaattcccttcccgccctatcctagactttaa

SEQ ID NO: 389268 - DNA, 817 bp, Homo sapiens
  misc_feature: GZ8MTXP02JCKVG.44.23.C01.1.454.CMB.2.raw
  modified_base (212)..(212): a, c, t, g, unknown or other
  modified_base (270)..(270): a, c, t, g, unknown or other
  modified_base (336)..(336): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgtaggagtcgggcccaggactggtgaggccttcgggaaccctgtctctcatctgcactgtctctggagtttccatcgtattctntctactcttcggtcgggtcgtagtacgtccgacgacccgacccggaggggaaggtagnggtaggtgtagttggtacgactcactattactcggtcggacgtacgtactactccgtcccgtccanaagcgtcgtcaccacttacgtttacgggacgacgtaccgtactagtaaaccgaccgttccttcccctccgtaaacgtaacgttacccgtacccgttcggtcccgacccggcccgggaccgaaccggtacccgggtttacgtttttacgttccgttggaccggacggtacggacgaacgttccggttcggttttaccccttaataaacgtttccgttagggggtcccggggtcccgggttacgtccccccttacgggtttcggtaacccttacgggtttcccgttccccttccgttaacgaccgtttcccccttaaaacccggaacccggggtaaccggtccccttaacggggtttccccgtttcccccccgtttccccgggcggggccccctttccccgggccttaaccccttaacccgggaacggacccttaacccccgtaccggtttcgggggccggtaaaccccgaccggtcccgggg

SEQ ID NO: 389269 - DNA, 579 bp, Homo sapiens
  misc_feature: GZ8MTXP02HFBHE.44.23.C01.1.454.CMB.2.raw
  modified_base (300)..(300): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgcccccgagggagggaatggagtggattggngacatccagttatacgtggggcgacgtactactctccgtcctcaacgtagtcgtctcacctatttcgagggacacgtccatcgaaccgcttcctccctagaactcgacctccgtcgacccgccgacggactacggtcctttattcagtgcgaggcgagtactcggtctttacaattcgtaggtcggggtccgtggtccacccgttggtcctacgtcgtccttccgtcacgtccgttacccgaccgtacgggcccctacgttcccggtcctttcccccgg

SEQ ID NO: 389270 - DNA, 526 bp, Homo sapiens
  misc_feature: GZ8MTXP02F3A7T.44.23.C01.1.454.CMB.2.raw
  modified_base (521)..(521): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggagaggcccctaaaggtcctcgtctctcgtgaaaccagactggaaggtagagtcccgtcaggttcagtgccagtccaggtggtgggcccggagtccactctcaccattagcgacctgcggcctgaagattctgcaacttatttctgtcagcagtatcatagtgccccgttcacttttggcctagggggacccaagctggaaatcaaaacgactagtggctgcaccatctgtcttcaatccttcccgcatctnattaa

SEQ ID NO: 389271 - DNA, 562 bp, Homo sapiens
  misc_feature: GZ8MTXP02FQ8LT.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagccccccgagggacggggaatggagtggattggtgacagtccatatacgtggggcgacgtactactctccgtcctcacgagtcgtctcactattcgagggacacgtccatcgaaccgcttctccctgaaacctgacctccgtcgacccgccgcggaccacggtccgtttattctgtgcgaggcgagactggtcttcaactctagcggggtccgtggccaccgtggtacctcgtcggtccttccgtcacggtccttaccaccgtaacggccctagtcccggttcctttccccccgg

SEQ ID NO: 389272 - DNA, 646 bp, Homo sapiens
  misc_feature: GZ8MTXP02JRU0Z.44.23.C01.1.454.CMB.2.raw
  modified_base (342)..(342): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttggggctggatccggcacgccccgagggaggggaatggagtggagttggtgacatccattatacgtgggcgacgtactactctccgtcctnaacgtagtcgtctcacctatttcgacggggacacgtccatcgaaccgtcttcctccctagaaacctcgaccctccgtcgacccgtcccggacggaccgaccgggtccgtttacgtttccgtggttacgcggtagggcgtacggtaccgttggttcctttacgtaaacgttcgttaaggtcgggggtcccgtcgggtccgtaccccgttgggtacctacgttcggttccttcccgtacgtaaccgtccttacccgaacccggtaacggggtcccctacggttcccggttacccctttccccccgg

SEQ ID NO: 389273 - DNA, 569 bp, Homo sapiens
  misc_feature: GZ8MTXP02GU2Q5.44.23.C01.1.454.CMB.2.raw
  modified_base (522)..(522): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatggagtggattggtgacagtccattatacgtggggcgacgtactactctccgtcctcaagagtcgtctcaccatttcgaggacacgtcatcgaaccccgtcttcctcctagaaactcgacctccgtgaccgccgcgacacggtcctttattctgtgcgaggcgagactcggtcttactaatctaagtggggtccgttggcctaccgtggtccacgtcgtctccgtcacgtccttccaaccgacggaccacgtccgtcccttcccctcggccncccgtcgtcctccgacggacgccacccgttcgacgggggccaaccgg

SEQ ID NO: 389274 - DNA, 633 bp, Homo sapiens
  misc_feature: GZ8MTXP02GZXHS.44.23.C01.1.454.CMB.2.raw
  modified_base (364)..(364): a, c, t, g, unknown or other
tcagacagtatatacacgaccggtgctcgatttagtacacgtgattagggattggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagtttctgtatcattcttggggctggatccgggcacggcccccgaggggaggggaatgggaggtggagttggtgacgatcctattatacgtggggcgacgtactactctccgtcccctcaacgngtcgtctcactgtttcgaggaccacgtccatcgaacccgtcttcctccctagaaacctcgacccttccgtacgacccggcccggaccggaccgtaccgggttaccgtttattttccgtggttcgcggacgggtcgacggtaccttgggttacctttcaatttccgtaggtcgggggtccgtggccctacccggttcgggtcctaccgttcgttcctcctcgtacgtcctttaccccgaaccggttaaccggcccctacgtttcccccgg

SEQ ID NO: 389275 - DNA, 581 bp, Homo sapiens
  misc_feature: GZ8MTXP02HQZ1H.44.23.C01.1.454.CMB.2.raw
  modified_base (467)..(467): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatgggagtggagttggtgacatccattatacgtggggcgacgtactactctccgtcctcaacgagtcgtctcacatttcgcggacacgtcagtcgaaccgcttctccctgaaactcgacctccgtcgaccgccgcggacacggtccttattcgtgtcgcgtagcgagtactggtctttnaattctagtcggggccgtcggacctaccgttggtcctacgttcgtccgttccctcgcgtcccgttacccgaccgtaaccggggcccctacggtcccggttccctttccccccgg

SEQ ID NO: 389276 - DNA, 569 bp, Homo sapiens
  misc_feature: GZ8MTXP02H93YF.44.23.C01.1.454.CMB.2.raw
  modified_base (239)..(239): a, c, t, g, unknown or other
  modified_base (271)..(271): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccggcgagtcaggtcgttttcggngtctgttgccttggttacaaacgaaaaggggnacggcccctaaaggtcctcgtctcgtcgtgaaacccagactgggaaggtagacgtcccgtcaggttcagtcgcagtccgagggtggtgggcccgagtccactctacaccattacgccgtactcggaccgtcctaggaaacgtattcgtgactaactttatttctgtacagcagtatctagtagtcgtcccgttactacgtttggaccccgagggtaccaagtctaggaaactacgaaacgtaacgtgtacgctagactaccatctcgttctctaacgttcctccgctactctatacta

SEQ ID NO: 389277 - DNA, 578 bp, Homo sapiens
  misc_feature: GZ8MTXP02IGU93.44.23.C01.1.454.CMB.2.raw
  modified_base (221)..(221): a, c, t, g, unknown or other
  modified_base (241)..(241): a, c, t, g, unknown or other
  modified_base (275)..(275): a, c, t, g, unknown or other
  modified_base (421)..(421): a, c, t, g, unknown or other
  modified_base (446)..(446): a, c, t, g, unknown or other
  modified_base (455)..(455): a, c, t, g, unknown or other
  modified_base (529)..(529): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagctcaccatcacttgccgggngagtcaggttcgttttcggngtctgttgccttggtttacaaacgaaaagggggnacggacccctaaaggtcctcgtctctcgtgaaaccagactggaaaggtagacgtcccgtcaggttcagtgccagtccgaggtggtggccccgagtccactctcaccattcgccgactgccgcctaggaatattctgacctaaattnttctgtcagtcagtatcatacgtcnccccgtttnttacttttgggacgtaggggaccctaaaggtctaaggaaaacttcgaaaacgctggtacgctaggcaaaccctntccgttcgttccttacgtaacttcctcccgtctacttctactacttaac

SEQ ID NO: 389278 - DNA, 656 bp, Homo sapiens
  misc_feature: GZ8MTXP02G317P.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccattctagttctgtatctattcgttggggctggactccggcacgcccccgaggggacgggaagtgggagtggagttggtgacatccattatacgtgggacgtacgtactctacctccgtcctcaacgtacgtcgtctctacctacgtttcgacggggtactacgtcctagtacgaaccgtcctttacctccctagtaaaccgtcgtaaccctccggtccgacccggccggaccggtaccgaccgggttccgtttactttcgtcggttcggacggtagggtccgtaggtaccgttcggtctttacgaaacttcgtaggttcggggccgttcggccctaccggttcggtccgacgttcgtccttccgtcgtacgtccttacccgaaccgacggtcccctacggttcccgtacccgtttcccccgg

SEQ ID NO: 389279 - DNA, 621 bp, Homo sapiens
  misc_feature: GZ8MTXP02FPX0N.44.23.C01.1.454.CMB.2.raw
  modified_base (577)..(577): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgttccatcagttctgatctattcgttgggctggatccggcacgcccccgaggggagggatggagtggagttggtgacatcctattatacgtggggacgacgtactactcctccgtccctacgaagtacgtccgtctccacctatttaccgggaggtacaccgtccactcgtaaaccgtcttcctaccctagtaaacctcgaaccctccgtacggacccgccggacggaccgtacgggtacccgtttagttcgtggtcggcggaggtccgtaggtaccgttggttcctttacgaacttcgtagggtcggggtccgtcggcctacccgtggtcctacgtcgtcctaccncacgtctaccgacgtacggccctacgttccgtcctttcccccgg

SEQ ID NO: 389280 - DNA, 591 bp, Homo sapiens
  misc_feature: GZ8MTXP02GSD49.44.23.C01.1.454.CMB.2.raw
  modified_base (241)..(241): a, c, t, g, unknown or other
  modified_base (270)..(270): a, c, t, g, unknown or other
  modified_base (399)..(399): a, c, t, g, unknown or other
  modified_base (417)..(417): a, c, t, g, unknown or other
  modified_base (446)..(446): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngctgttgcctggttacaacgaaaaggggnacggcccctaaggtcctcgtctcgtcgtagaaaccagactgggaagtagacgtcccgtcaggttcagtgccagtccgaggtggtcgggcccgagtccactctcaccattcgcgacctgccgcctgaatnttctgctaacttatttcngtcagctagtatcatagtcgtccccgttntacgtttggccgaacggggaccaaggtccgtaggaaaacttaccgaaaacgtaacgtggtacggacttacggcctaacctacgttcctcgttccttacctaacgttcccttaccccggtacctacgtccttacgtactttaaacg

SEQ ID NO: 389281 - DNA, 690 bp, Homo sapiens
  misc_feature: GZ8MTXP02GLVQ1.44.23.C01.1.454.CMB.2.raw
  modified_base (276)..(276): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgccccgaggggaggggaatgggagtggtagttgggngacgatcctagttagtacgtggggcgtacgtacctaccgtctcccgtcctcgaagcgtcgtcctcacctagtttcgaggaccacgtccagtacgaccccgtctcctacctacgaaactcgtacctccgtcgacccgtccggaccgaccgtaccggttaccgtttactttcgtcgtacggtcggacggtacgacgtacgttcggtttacctttacgaacttcgtaggttccgggggtccgtacggtcccgtacccgttgggttaccctcgttccgtccttccgacgtacgtcccttcccgaaacccgtaaccggtccccgtacgttcccggggttccccttcccccggcggtccccgtccccgttcgccttaaccggacgaccgtccgtacccgttcgggcggggtaccaccggg

SEQ ID NO: 389282 - DNA, 675 bp, Homo sapiens
  misc_feature: GZ8MTXP02HLEL2.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatctatttcgttgggctggatccggcacgccccgagggagggaatgggagtggagttggtgacatccattatacgtgggcgtacgtactactcctccgtccctcgaagacgtcgtctacacctatttcgaggacacgtcatcgaaccccgtcttcctcctagtaaactcgaacctccgtacgaccgccggaccgaccgtaccggtccgtttttacttccgtggtcgacgacgggcggaaacgttacgttgggttacccttttaaacgaacgttcggtagggttccggggtccgtccggtaccgttaccgtcggttacctcgttcgtccctccgtacgtaccgtacccttacccgaaccggtacccggtccctaccggtttcccgtccccgttccccggtccgtcccgtcccgttaccgcccgtaaccggacgccgtacccgtaccggtcgggacggaccacgg

SEQ ID NO: 389283 - DNA, 566 bp, Homo sapiens
  misc_feature: GZ8MTXP02JIL4A.44.23.C01.1.454.CMB.2.raw
  modified_base (365)..(365): a, c, t, g, unknown or other
  modified_base (422)..(422): a, c, t, g, unknown or other
  modified_base (519)..(519): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatgggagtggattggtgacatccattatacgtggggcgacgtactactctccgtcctcaacgagtcgtctcacctagtttcgngggacacgtccatgaaccgcttctccctgaaactcgacctccgtgaccgccgcgacncggtcctttattcgtgtgcggtagcgagtacgtggttcttacactcgtaggtcggggtccgtgggacctcccgtgggtcctacgtgtcctacccgtnacgtcgttacccgaccgacggtcctacgtccggttcccttcccccgg

SEQ ID NO: 389284 - DNA, 593 bp, Homo sapiens
  misc_feature: GZ8MTXP02IBXES.44.23.C01.1.454.CMB.2.raw
  modified_base (307)..(307): a, c, t, g, unknown or other
  modified_base (348)..(348): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgtatcatttcgtgggcttggactccggcacgcccccgaggggacgggaatggagtggagttggngacatcatagtcgtgggcgtacgtactactctccgtcctanacgactcgtctcactagttcgagtacacgtccatacgaccgtcttcctccctagaaacctcgtacctccgtcgaccgccgcgacgcgtccgtttatccgttgtcgcgtacggcgtagtacgtgttctttacagttcgtagtcggggtccgtcggtcctaccccggttggtacctacgttcgtcccttcctcgtacgtccgttcccgaaccgtaacgggccctacggtcccgttcccttcccccgg

SEQ ID NO: 389285 - DNA, 595 bp, Homo sapiens
  misc_feature: GZ8MTXP02IBXEA.44.23.C01.1.454.CMB.2.raw
  modified_base (309)..(309): a, c, t, g, unknown or other
  modified_base (356)..(356): a, c, t, g, unknown or other
  modified_base (380)..(380): a, c, t, g, unknown or other
  modified_base (409)..(409): a, c, t, g, unknown or other
  modified_base (479)..(479): a, c, t, g, unknown or other
  modified_base (570)..(570): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggatggagtggagtggtgacatccattatacgtgggcgacgtactactcctccgtcctnaacgagtctctcactattcgaggacacgtcatcgaaccccgcttccncctagaactcgacctcgtcgaccnccgacgacctccggtcttttactccgtgngacgtagcgaagtcgttggttactttacaagttcgtaagcggggtccgtcggcctacccgtgggttaccncgttcgtcctctcgcgtcctaccgaacgacggtcctacgttcccggttcccttccccggcgccccgtcccgtacgcccgtaacgcggaccnccgaccgttcgggacgggaccacgg

SEQ ID NO: 389286 - DNA, 646 bp, Homo sapiens
  misc_feature: GZ8MTXP02HWHRT.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcatttcgttggggctggactccggcacgccccgagggaggggagtggagtggagtggtgacatcattagtacgtgggacgacgtactactctccgtcctcagagtccgtctcactatttcggaggacacgtccagtcgaaccccgtcttcctcctacgaaactcgacctccgtcgacccgccgccgaccgtcggtaccgtttattccgtgtcggcgacggcgaagtcgttcggttactttacgaagttcgtagtcggggcccgttggacctacccggttggtccacgttcgtacctcccgtacgacgtcccttaacccgaccgtaaacggggtcccctacgtttcccggtccccttcccccggtcggtccccgtaccgtcgccctcccggaaggacccggtccaccgtttccggacgggggacccaaccgg

SEQ ID NO: 389287 - DNA, 595 bp, Homo sapiens
  misc_feature: GZ8MTXP02IUBY0.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggagggaatgggagtggattggtgacatccattatactggggacgacgtactactctccgtcctcagacgtcgtctcaccatttcgaggacacgtccatgaaccccgcttcctcctgaaactcgacctccgtgacccgccgccgaccacggtccgtttatttcgtgtgcgaggcgaagtaatggttctttcgaattcgtagtcggggccttgggcctacccgtggtccacttcgtcctcctcacggtccttccaaccgtaacgggccctacgtcccggtcctttcccccgtcggcccgtcccttcggcccttccgaacggtcgacctaccgtcggtcgggggacaaccggg

SEQ ID NO: 389288 - DNA, 570 bp, Homo sapiens
  misc_feature: GZ8MTXP02IOBMZ.44.23.C01.1.454.CMB.2.raw
  modified_base (368)..(368): a, c, t, g, unknown or other
  modified_base (514)..(514): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatgggagtggattggtgacagtccattatacgtggggcgtacgtactactctccgtccctcaagagtcgtctcacctatttcgngggacacgtccatcgaacgcttctccctgaaactgacctcgtcgaccgccgcggacacggtcctttatttcctgttgcgtaggcgagacctggtctttcgaatctagtggggcgtggcacccgtggtccacgtcgttcctcctacncgtccttacccgaccgtaaacggggtcccctacgttcccgggtcctttccccccgg

SEQ ID NO: 389289 - DNA, 560 bp, Homo sapiens
  misc_feature: GZ8MTXP02JOLZ3.44.23.C01.1.454.CMB.2.raw
  modified_base (240)..(240): a, c, t, g, unknown or other
  modified_base (269)..(269): a, c, t, g, unknown or other
  modified_base (394)..(394): a, c, t, g, unknown or other
  modified_base (399)..(399): a, c, t, g, unknown or other
  modified_base (443)..(443): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggtcgttttcggngctgttgcctggtttcaacgaaaaggggnaggcccctaaggtcctcgtctctcgtgaaaccagactggaagtagagtcccgtcaggttcagtgccagtccagggtggtgggccccggagtcccactctcaccattcgcgactgcgctgaacgtnttccngctaattattctgtcagcagtactcattacggtcgccccgtttntacgttttcgggccgtaacgggggacccaaagccgttaggaaatccgaaaacgtactgtacggctgaccaccatcctagtcctttacaactccctttcccgcctattcctagactta

SEQ ID NO: 389290 - DNA, 626 bp, Homo sapiens
  misc_feature: GZ8MTXP02IGOQA.44.23.C01.1.454.CMB.2.raw
  modified_base (334)..(334): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggaatgggagtggagttggtgacgatccattatacgtgggcgtacgtactacctctcccgtcctctaagacgtccgtctcacctntttcgaggacacgtcatcgaacccgtcttcctcctagaaactcgacctccgtcgaccgtcccgcggacctcggtacctttattctagtcgtcgagcgtagacgtggtctttacgaactcgtaagtcggggtcctggaccctaccgttcgggtaccactcggttcctcctctacgtccttaccgaacgtaacgggccctaagttcccgggttcctttcccccggtcgtcccgtccccgtcgtccgtaacccgtacggacgcccgaaccgtttccggacgggggtaccaaccgg

SEQ ID NO: 389291 - DNA, 602 bp, Homo sapiens
  misc_feature: GZ8MTXP02GB5LX.44.23.C01.1.454.CMB.2.raw
  modified_base (404)..(404): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggaagtggaggtggagttgggtgacagtcctattagtacgtggggcgtacgtactactctccgtcctcaagagtcgtctcacctattcgaggacacgtcatcgaaccccgtcttcctccctacgaactcgacctccgtcgaccgccgacgacncggtctttattccgtgtcgcgaggcgagtactggtctttacaatcgtagtcggggccgtggacctaccgtggtacctacgtcgtcctcctcgacgtccttacccgaccgtaacgggccctagttcccggttcccttcccccgtcggcccgtcccgtgcccgtccgacggacgcctaccgtcggtcggggaccaaccgg

SEQ ID NO: 389292 - DNA, 565 bp, Homo sapiens
  misc_feature: GZ8MTXP02H9IR3.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggatggagtggattggtgacatccattatactggggcacgtactactctccgtccctcaagagtcgtctcacctatttcgagggacacgtccatcgaacccgcttcctccctagaaactcgacctccgtcgaccgccgcgacacggtccgtttattcctgtgcgaggcgagacgtggttctttcaattcgtatggggccgtggcctacccgtggtcactcgtctccttcacgtcttccaccgaaacgggcccagtccggtcttcccccgtggccgtccctcgcctccgacggacgccaccgtcgtcgggggcaccgg

SEQ ID NO: 389293 - DNA, 574 bp, Homo sapiens
  misc_feature: GZ8MTXP02ISW3L.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggagggaatggagtggattggtgacatccattatacgtggggcgacgtactactctccgtcctcagagtcgtctcacctatttcgaggacacgtccatcgaaccccgcttcctccctagaaactcgacctcgtcgacccgccgcgaccacggtcgtttattctgtgcgaggcgagacttcggtctttacaatctagtcggggccgtggctaccgtggtcactcgtctcctcacgtccttaccacgaacggcccacgttccgggtcccttcccccgtcggcccgtcccgtcgcctccgacggacgcctaccgtcggtcgggggacaccgg

SEQ ID NO: 389294 - DNA, 556 bp, Homo sapiens
  misc_feature: GZ8MTXP02FGY2T.44.23.C01.1.454.CMB.2.raw
  modified_base (242)..(242): a, c, t, g, unknown or other
  modified_base (342)..(342): a, c, t, g, unknown or other
  modified_base (444)..(444): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttcngatcattcttggggctggatccggcagcccccagggaggggaatggagtggattggtgacatccattagtactggggcgacgtactactctccgtccctnaacgagtcgtctcacctatttcgaggggacacgtccatgaaccgtcttctccctgaaactgacctcgtgacccgccgcggacacggcgtttattctgtgcgngcgagactggttcttacgaattctagtggggccgtggccacccgtggtccacgttcgtcctccgctacgccttacccaccgaacgggccccagtccggtcctttccccccgg

SEQ ID NO: 389295 - DNA, 550 bp, Homo sapiens
  misc_feature: GZ8MTXP02GYFLN.44.23.C01.1.454.CMB.2.raw
  modified_base (240)..(240): a, c, t, g, unknown or other
  modified_base (271)..(271): a, c, t, g, unknown or other
  modified_base (301)..(301): a, c, t, g, unknown or other
  modified_base (307)..(307): a, c, t, g, unknown or other
  modified_base (411)..(411): a, c, t, g, unknown or other
  modified_base (438)..(438): a, c, t, g, unknown or other
  modified_base (453)..(453): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttggccgggcagtcaggttcgtttcggngctgttgccttggttacaaacgaaaaggggngacggcccctaaggtcctcgtctctcgtanaaaccngactggaagtgacgtcccgtcaggttcagtgccagtccgaggtggtggccccggtagtccactctacacctagttcgcgacctggccgtcctagaagtacttcngtactaacttattctgtcagctagtancatagtcgcccgttntacgtttggaccgtagggacagcgtagaaatcaaagatgacggctagacactactctcgtcttacaacttccttacccgctactcctagtactaacg

SEQ ID NO: 389296 - DNA, 598 bp, Homo sapiens
  misc_feature: GZ8MTXP02F17N4.44.23.C01.1.454.CMB.2.raw
  modified_base (414)..(414): a, c, t, g, unknown or other
  modified_base (543)..(543): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggactccggcacgccccgagggagggaatgggagtggagttggtgacatcattagtacgtgggcacgtactactctccgtcctcagacgtcgtctcactagttcgaggacacgtccatcgaaccccgtcttcctccctagaactcgacctccgtcgacccgccgaccgactaacggtcctttattcgngtgcggagcgagtactggttctttacgaattcgtagtcgggggcccgttggccctaccgtggtaccacgtcgtctccgtcgacgtccttcccgacgaacgggcccctagtccggttcccttcccccggnggcccgtcctcgccgtaacccgaggtccgaccaccgttcggcggggaccaaccgg

SEQ ID NO: 389297 - DNA, 686 bp, Homo sapiens
  misc_feature: GZ8MTXP02FZPKQ.44.23.C01.1.454.CMB.2.raw
  modified_base (220)..(220): a, c, t, g, unknown or other
  modified_base (240)..(240): a, c, t, g, unknown or other
  modified_base (272)..(272): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttccttcctgtcttcttctgttggaggcagcgtcaccatcacttgccggngagtcaggttcgttttcggngctgttgcctggtttacaaacgaaaagggggngacggccccgtaagggtcctcggtctcgtcgtacgaaaccagacgtgggaaggtagacggtccccgtcgtaggttcaggtcgccgtaggtccgaggggtcgggtcggggccccggtacgtcccacgtctcaccctattacgcgacctgccgcctagaaagcttctgacctaactttatttcgtgtcagtctagttactacattacggtcgtaccccgttcttacgttttcggaccggtaacggggacccaaggtaccgtaagggtaaaactaccgtaaaaccggtacgttacggttacgggaccttacggacctaaacccggtaactttccgttaccggttaccttttccgtaacctttccccggtttaaccccggacccttaaactttccgttaaacggtacttttaaaaccg

SEQ ID NO: 389298 - DNA, 603 bp, Homo sapiens
  misc_feature: GZ8MTXP02F38CW.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaatggagtggattggtgacatccattatacgtgggcgacgtactactctccgtcctcaagagtcgtctcaccatttcgaggacacgtcatcgaaccccgcttcctccctgaaactcgacctccgtcgaccgccgccgaccacggtccgtttatttcgtgtgcgaggcgagacgtggttctttcaatctagtggggtcccgtggccacccgttgggtccactcgtccttccgtcacgtccttaccgaccgaacggggcccctacgttcccgggttccctttcccccgtcggtccccggccccttcggcccttcccgacggaccgccctacccgtcggtcgggggaccaacccgg

SEQ ID NO: 389299 - DNA, 596 bp, Homo sapiens
  misc_feature: GZ8MTXP02JGL73.44.23.C01.1.454.CMB.2.raw
  modified_base (419)..(419): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaatggagtggattggtgacatcattatacgtgggcgacgtactactcctccgtcctcgagacgtcgtctcacctagtttcggaggacacgtccagtcgaaccccgtcttcctcctacgaaactcgaccctccgtcgaccgccgcgacacggtctttacttctgtcgcgnggcgagtacgtcggtctttcaatcgtagtcggggccgtcggcctaccgtcgtctacgtcgtcctcctcacgtccttaccgaaccgtaacgggaccctacgttcccggttcccgttccccgtcggtcccgtccccgtcgccgtccgacggacgccgaccgtccggcggggccaccggg

SEQ ID NO: 389300 - DNA, 586 bp, Homo sapiens
  misc_feature: GZ8MTXP02I2P4W.44.23.C01.1.454.CMB.2.raw
  modified_base (461)..(461): a, c, t, g, unknown or other
tcagacagtatatacacgaccggtgctcgatttagtacacgtgattagggattgggggatgcttttctgagagtcaaggacctcctgtgcaagaacatgaagcacctgttggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccaggggacggggaagtggagtggagttggtgacgatcctattagtacgtggggcgacgtactactcgtccgtcccctacaagacgtcgtctcacctgtttcgagggacacgtccatcgaaccgcttctccctagaaactcgaacccttcgcgaccgccgacgacacggtccgtttattcngtgcgtaggcgacgctggtctttcgaatcgtagtcggggtccgtggcctacccgtggtacctacgttcgtcctccttcgacgtcctttacccgaaccgtaaacggggcccctaagtttcccccgg

SEQ ID NO: 389301 - DNA, 605 bp, Homo sapiens
  misc_feature: GZ8MTXP02IF6YP.44.23.C01.1.454.CMB.2.raw
  modified_base (310)..(310): a, c, t, g, unknown or other
  modified_base (338)..(338): a, c, t, g, unknown or other
  modified_base (393)..(393): a, c, t, g, unknown or other
  modified_base (560)..(560): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggaatggagtggagttggtgacatccattatacgtgggcgacgtactactctccgtcctnagagtcgtctcacctatttcggaggacncgtcatcgaaccccgtcttcctcctagaactcgacctccgtcgaccgccgcgacncggtctttattctgtgcgaggcgagtacgttggttactttacaattccgtagtcggggtccgttcggcctacccgttggtccacgttcgtaccttcctcacgttccttacccgaaccgtaacggccctacgttcccggttcccttcccccgtcgggccctccccgtncccgtccgacggacgtcctaccggttccggcgggggaccaaccgg

SEQ ID NO: 389302 - DNA, 603 bp, Homo sapiens
  misc_feature: GZ8MTXP02GLYGP.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacggccccgaggggagggaagtggagtggattggtgacatccattatacgtgggcgacgtactactcctccgtcctcaacgagtcgtctcacctatttcgagggacacgtccagtcgaaccgcttcctaccctagtaaacctcgaccctccgtacgacccgccgacggacctaccgggtccgtttattccgtgtacgcgtaggcgtaggactcggttcttacgtaattccgtaggtcgggggtcccgtggtacctacccgtgggtccacgttcgtcctacctcacgtccttacccgaaccgtaacgggccctacgttcccggtccctttcccccgg

SEQ ID NO: 389303 - DNA, 638 bp, Homo sapiens
  misc_feature: GZ8MTXP02H1AZ8.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgtgggctggatccggcacgccccgagggaggggaagtggtaggtggtagtggtgactatcattatacgtgggcgacgtacgtactctccgtcctacaacgacgtcgtctctactagttcgacggacacgtccatacgaccgcttcctccctagaaacctcgaccttacccggcgtaaccccgccggtaccgaacccgtaaccggtcccgttttaacgttcgttcggtggacggtaggaccggtaggtaccgtgggttacctttactaaagttcctaaggtcggggtcccggtaggtcccgacccgttcggtacctaccgttcgtcctaccgtcctacggtccttacccgaacgaccggtacccgtactcccgggttaccctcccccgg

SEQ ID NO: 389304 - DNA, 679 bp, Homo sapiens
  misc_feature: GZ8MTXP02H9Q3T.44.23.C01.1.454.CMB.2.raw
  modified_base (222)..(222): a, c, t, g, unknown or other
  modified_base (349)..(349): a, c, t, g, unknown or other
tcagacagtatatacacgaccggtgctcgatttagtacacgtgattagggattggggctttctgagagtcaaggaccctcctgtgcaagaacatgaagcacctgtggttttttcctcctgctggtggcagctcccagatgggtcctgtcccaggtgcagctgcaggagtcgggcccaggactggtgaggccttcggaccctgtctctcatctgcactgtctntggatttccatcagttctgatcattcgtgggctggatccggcacgcccccggagggacgggagtggagtggtagtggtgactatcctattatacgtggggacgtacgtacgtactcctccgtccctnaacgtacgttccgtctacctactacgtttcggagggtacctacgtacctaacgtcgaaacccgtctttaccctaccccgtaagaaaaccttcggtaaacccttcccggcggaacccccgccggaccgggaacccgtaaccgggttccgttttaacgtttccgttggttacgcggttaacgggcgtaacggtaccgttgggtttacctttacgtaaattccggttaaggttggggacccggtacgggtcctaccccggtttggacctacgttcgttcctaccgttcacgtccttaccgaccgtaacggtcctacgtccgttccctccccgg

SEQ ID NO: 389305 - DNA, 605 bp, Homo sapiens
  misc_feature: GZ8MTXP02IF150.44.23.C01.1.454.CMB.2.raw
  modified_base (241)..(241): a, c, t, g, unknown or other
  modified_base (273)..(273): a, c, t, g, unknown or other
  modified_base (476)..(476): a, c, t, g, unknown or other
  modified_base (588)..(588): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgttttcggngtctgttgccttggtttcaaacgaaaaggggngacggcccctaaggtcctcgtctctcgtagaaaccagactgggaagtagacgtcccgtcaggttcagtcgccagtccgagggtggtgggccccggagtcccactctacaccattcgccgacctgccgccttggaaatcttctagactaactttattctgtacaggtactagtactactagttacggttccgtacccccgtttnttaccgttttcgggacccgtaacgggggaccctaaagaccgttaaggaaacttacgaaacgtaactggtacgctcgactacgaacttctcgttcttcaacttccgttacccnctacttcgtatactaac

SEQ ID NO: 389306 - DNA, 695 bp, Homo sapiens
  misc_feature: GZ8MTXP02IR4K2.44.23.C01.1.454.CMB.2.raw
  modified_base (221)..(221): a, c, t, g, unknown or other
  modified_base (242)..(242): a, c, t, g, unknown or other
  modified_base (277)..(277): a, c, t, g, unknown or other
  modified_base (316)..(316): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttccttctgtcttcttctgttggaggcagcgtcaccatcacttggccgggngagtcgaggttcgttttcggngtctgttcgccgttggttacaaacggaaaaggggngacggacccctaaggtcctcgtctcgtcgtacgaaaccngacgtggaaggtacgacgtccccgtcaggttcagtcgccaggtccgagggtcgggtcggggccccggtagtcccacgtctaccaacctagttacggccgtacccgtgggacccgtccgtaggaaacgtatttcgtagtacttaaactttatttctgtacacgtactaagtactaccgtagttacggttcccgttcccccgtttcttaccgtttttccgggaccggtaaacggggaaccctaaggtaccgttaaggaaaacttaccggaaaaaccgtagttcgggttacggacttacggacctaaaccgtacttcgttcgttacctttaccgtaactttcccccgttcccggacctacgttccgttaagtaactttaacg

SEQ ID NO: 389307 - DNA, 595 bp, Homo sapiens
  misc_feature: GZ8MTXP02IYPRP.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatggagtggattggtgacatccattatacgtggggcgacgtactactctccgtcctcagagtcgtctcaccatttcgaggacacgtccatcgaaccccgcttcctcctgaaactcgacctcgtcgaccgcgcgacacggtcgtttattctgtgcgaggcgagactggttctttcaaatctagtcggggcccgttggcctacccgtgggtccacgttcgtcctcctcgacgtccttacccaccgaacgggtccccaacgttcccgggttcccttttcccccgcggtcccgtcccccgtgtccctccgaacgggcgacccgccgttcggtcgggggacccaaccggg

SEQ ID NO: 389308 - DNA, 698 bp, Homo sapiens
  misc_feature: GZ8MTXP02IO64H.44.23.C01.1.454.CMB.2.raw
  modified_base (323)..(323): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggatccggcacgccccgagggagggaagtggaggtggagttggtgacatccattatacgtggggcgacgtactactctccgtacctacaacgngtccgtctcacctagtttcggaacggacacgtccatacgaaccccgtcttcctccctagaaactcgtaccctccgtacgacccggcccgaccggaccgtaccggtaccgttttacttccgtggtcgtacggacggcgtaacgtacgttgggttactttaccgtaagttcgttaacggtcgggggtcccggttacggacccgttaaccccgttcgggttacctaccgttcgtcccttcccgtacgtaccgtccttacccgaacccgaaacggggtcccctaacggtttcccggttccccttcccccggtcggtcccgtcccccgttcggcccttccgaggtaccgcccgaaccgtccggtacgggggccaaccggg

SEQ ID NO: 389309 - DNA, 623 bp, Homo sapiens
  misc_feature: GZ8MTXP02HGY6J.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttgggctggatccggcacgccccgagggagggaatggagtggagttggtgacagtcctattatacgtgggcgacgtactactcctccgtcctcagagtctctcactactttcggaggacacgtccactcgaaccccgtcttcctcctacgaactcgacctccgtcgaccgcgccgacacggtcttacttcgagtcgcgacggcgagtacgtcgtctttacaattcgtagtcggggcttcggcctacccgtggtcctcgttcgtcccttccgtacgtacgtcccttaccgaacccgtaacggtcccctacggttcccggttccccgtttccccgtcgggcccgtcccccgttggaccccttccgacggtaccgccgtaacccgtcggggtacggggctaacccggg

SEQ ID NO: 389310 - DNA, 598 bp, Homo sapiens
  misc_feature: GZ8MTXP02GDZJF.44.23.C01.1.454.CMB.2.raw
  modified_base (377)..(377): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaccctgtctctcatctgcactgtctcgtggtagtttccatcagttctgattctattcgttggggctggactccggcacgcccccgagggacggggaatggagtggagttggtgacatccattatacgtggggcgacgtactactctccgtcctacaacgacgtcgtctcacctagtttcgngggacacgtccatacgtaaccgtcttcctcctgaaacctgaccctccgtcgaccgccgcggacaccggtcctttattctgtcgcgtgcgagtacgtggtctttacatcgtagtcggggaccgtcggccgtacccgttggcctacgttcgtccgttccgtacctacgtcccttaccgaacccgtaacggggcccctaccgttccggttccctttccccccgg

SEQ ID NO: 389311 - DNA, 539 bp, Homo sapiens
  misc_feature: GZ8MTXP02IZH8Q.44.23.C01.1.454.CMB.2.raw
  modified_base (271)..(271): a, c, t, g, unknown or other
  modified_base (305)..(305): a, c, t, g, unknown or other
  modified_base (390)..(390): a, c, t, g, unknown or other
  modified_base (394)..(394): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctggtttcaacgaaaaggggnaggcccctaaggtcctcgtctctcgtagaaaccngactgggaagtagacgtcccgtcaggttcagtgccagtccaggtggtggcccgagtccactctcaccatgcacctgcgcctgagnttcngctacttattctgtcagcagtatcatagtcgtccccgttctacgttttcggccgtacggggaccaagctaggaaaactcaaaacgactagtcggctgcaccactcgtacgttcttcaacttccttcccgctactctgtacttaac

SEQ ID NO: 389312 - DNA, 578 bp, Homo sapiens
  misc_feature: GZ8MTXP02FNMSJ.44.23.C01.1.454.CMB.2.raw
  modified_base (369)..(369): a, c, t, g, unknown or other
  modified_base (535)..(535): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgcccccgagggacgggaagtggagtggattggtgacgatccattatacgtggggcgacgtactactctccgtccctcaacgagtctctcacctatttcgnggacacgtccatcgaaccgcttctccctgaaactcgaaccctcgtcgacccgtccgacgaccgacggtccgtttattccgtgttcgcgtaggcgagacgtgggttctttacgaacttcgtagtcggggccgttggcctacccgtggtctacgttcgtcctcctacncgtccttccgaccgtaacggccacgtccggtcctttcccccgg

SEQ ID NO: 389313 - DNA, 583 bp, Homo sapiens
  misc_feature: GZ8MTXP02GVC57.44.23.C01.1.454.CMB.2.raw
  modified_base (244)..(244): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggngggaatggagtggattggtgacatccattatactggggcgacgtactactctccgtcctcaagagtcgtctcaccatttcgaggcacgtccatcgaaccccgcttctccctagaaactcgacctccgtcgaccgccgcgaccacggtcctttattcctgtgcgaggcgagactggtctttcaattctagtcggggccgtggcctacccgtggtccacctgtcctcctcacgtccttccaccgaacgggtccccaacgttccggtacccttcccccgtcggccccgtccccgtcggccctccgacggacgtaccgaccctccggtcgggggaccaccggg

SEQ ID NO: 389314 - DNA, 919 bp, Homo sapiens
  misc_feature: GZ8MTXP02G4IEK.44.23.C01.1.454.CMB.2.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttctctgtggagcagcgtcaccatcacttgccgggcgagtgccgacagttaggtacttttttggccttggtttcagcaggacgcctggacaaacgccccctaaagtcccctgtacttccttttcgtacggtacttccctacgttttaggaaacggtaggttacgggaaccgtttacccccgaacggtacccgttaacggggtttcccgaaacggggtcccggggtaccgttaaccggggtttccggggtttacccggttaacgggggtaaaccccttaacccgttaaaccggtttttttaccccgaaccccgttttccccgttaaccccgtaaacccccgttaaacctttaccccgaaacgggtccccaaaccgggttacccccgttcgggaccccgtaaacgggttcccccggtttaggggtaaaccgtttaaacgttttttccccggggaaccggtttaaacccttttttaaacggttaacccttaccgggtaaaaccccttaaaacgtttaaaacgtttttaaccttttttaccctttttttttaaaccggttaccccgttttaaaccgtttacgggttttttaccggggaaccccggtttaaacgggggaaaccccttaagggttaccgtaggggtaaacgtaacgttaaaccggaaaaggttaaccgtggtacggtaccgtacggacctaactaagttcttacgtacttacgtactttcccgttaccgtacc

SEQ ID NO: 389315 - DNA, 554 bp, Homo sapiens
  misc_feature: GZ8MTXP02FJEPZ.44.23.C01.1.454.CMB.2.raw
  modified_base (362)..(362): a, c, t, g, unknown or other
  modified_base (489)..(489): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccaggaggggaatggagtggattggtgacatccattatactggggcgacgtactactctcgtccctcacgagtcgtctcaccactttcgngggacacttccatgtaaccgacttctccctcgaaacctcgacctcccgtcgtacccgccgcggacacggccgttatttctgtgtcgaggcgagactcggtctttcaatctagtggggtcgttcggcncccgtacggtcgactcgtccgtcctcacgcgttccacctacggcccactcggtcctttcccccgg

SEQ ID NO: 389316 - DNA, 642 bp, Homo sapiens
  misc_feature: GZ8MTXP02I9KM8.44.23.C01.1.454.CMB.2.raw
  modified_base (367)..(367): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtagtttccatcagttctgatctattcgttgggctggactccggcacgcccccgagggagggaatggagtggattggtgacatcattatacgtgggcgacgtactactctccgtcctacacgacgtcgtctcacctagttcgnggtacacgtccatcgaaccgcttcctccctagaaacctcgaccctccgtcgacccgtcccgacggaccgtaccggtccgtttactttccgtggttcgacgggtaggtccggtacggtaccgttcgggttccttttacgaaacgttcgttaaggtcgggggtccgtcggtacccgtccccgttgggtaccctacgttcgttcccttcccgcgtaacgtcccgtttacccgaaccgtaccggggacccctacggttcccggttcccgtttcccccgg

SEQ ID NO: 389317 - DNA, 559 bp, Homo sapiens
  misc_feature: GZ8MTXP02F3YJX.44.23.C01.1.454.CMB.2.raw
  modified_base (302)..(302): a, c, t, g, unknown or other
  modified_base (431)..(431): a, c, t, g, unknown or other
  modified_base (469)..(469): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggatccggcacgcccccgagggaggggaatgggagtggattggngacatccattatacgtggggcgacgtactactctccgtcctcaacgagtccgtctcacctatttcgaggggacacggtccatcgaaccgtcttctccctagaaactcgacctcgtgacccgccgcgacncggtcctttattcgtgtgcgtagcgagactggtcttanaatctagtcggggcgtggccaccgtggtctacgtcgtcctcgtcacgtcttacccaacgtacgggccctacgtccggtcctttcccccgg

SEQ ID NO: 389318 - DNA, 681 bp, Homo sapiens
  misc_feature: GZ8MTXP02GXKT3.44.23.C01.1.454.CMB.2.raw
  modified_base (243)..(243): a, c, t, g, unknown or other
  modified_base (326)..(326): a, c, t, g, unknown or other
  modified_base (422)..(422): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttctgtcttcttctgttggagcagcgtcacatcacttcggccgggcgagtcgtaggttcgtttcggngtcgttgttcgaccgttaggtttacaaacggtaaaaggggcgacggtaccccgtaaggtcctcgtctcgtacgtacgaaaccngtacgtagggtaaacggtacgaccgttccccgtacgtaacgggttcaggttcgcctacggtccgtaggggtcgggtcggggcccggagtccactcncacctagtcgccgacgtcggcgtcctaggaatacttcgtagtactaactttatttcgtgttacacggacttaagtactacgtacgttaacgtccgttccccgtttacgttacgtttcgggaccggtaacggggaccctaaggtaccgtaagggtaaaactaccgaaaacggtacgtcggtacggcttacgacctaccgtacttccgttacgttaccttacaacctttccctacccgtactactccgtactactttaacg

SEQ ID NO: 389319 - DNA, 597 bp, Homo sapiens
  misc_feature: GZ8MTXP02FNZNN.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggacgggaatggagtggagttggtgacatcattatacgtgggcgacgtactactctccgtcctcagcgtcgtctcacctagtttcgagggacacgtccagtcgaaccccgtcttcctaccctagaaacctcgaaccctccgtcgacccgccgaccgaccaccggttccgtttatttcgtgtcgcgaggcgagtacgtggttctttacaatcgtagtcggggccgtggccaccgtggtactactcgtcctccgtcacgtccttacccgacgaacggtcccacgttccgggttcccttccccgtcggcccgtccctcgcctccgacgacgtccaccgtcggtcggggcaccgg

SEQ ID NO: 389320 - DNA, 551 bp, Homo sapiens
  misc_feature: GZ8MTXP02JLMF6.44.23.C01.1.454.CMB.2.raw
  modified_base (354)..(354): a, c, t, g, unknown or other
  modified_base (398)..(398): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggattggtgacatccattatactggggcacgtactactctccgtcctcaagagtcgtctcaccatttcgaggacacgtccatcgaaccccgcttccncctagaaactgacctccgtgaccgccgcgacacggtcttattcngtgcgagcagactggtctttcaatctatggggcctgggccacccgtgggtcacgtcgtctcctcacgcttccaccaacggccctacgtccggtccgttccccgttccggccgcccgtccgccgtccgacgacgccgacctcgtcgggcgaccg

SEQ ID NO: 389321 - DNA, 643 bp, Homo sapiens
  misc_feature: GZ8MTXP02G5F03.44.23.C01.1.454.CMB.2.raw
  modified_base (317)..(317): a, c, t, g, unknown or other
tcagacagtatatacacgaccggtgctcgatttagtacacgtgattagggattggagcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggaggggaagtgggagtggagttggtgacatccattatacgtggggcgacgtactactcctccgtcctanaagagtcgtctcactattcgaggacacgtccatccgaaccgtcttcctcctagaaacctcgaccctccgtacgacccgccgccgacgtaccgggtccttttattcgtgtcgcggaggcgtagtacgtggttctttacaagttcgtagtcgggggtccgtcgggacctacccgtgggtaccacgttcgtccttccgtctaccggtcctacccgaaccggtaaccgggcccctacgttccccgggttcccttcccccgggtcggccccgtccccgtggtaaccccgtccggaacggaccgtccctacccggttcggggcgggggaccc

SEQ ID NO: 389322 - DNA, 630 bp, Homo sapiens
  misc_feature: GZ8MTXP02IOVC8.44.23.C01.1.454.CMB.2.raw
  modified_base (523)..(523): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcacgcccccgagggagggaagtggaggtggtattggtgacgatccattatacgtggggccgacgtactacctctccgtccctacaagagtccgtctcacctatttcgaaggaccacgtccatacgaaccccgtcttcctccctagaactcgaccctcggtcgacccgcccggaccgaccgtacggtccgtttttagttccgtgtcgtcgaggcgagtacgtcgggttctttacgaacttcgtaggtcggggtccgttcggacctacccgtggtctacctcgtcctctctntccttaccgacgacggtcccacgttccggtcccgtttcccccgcggtcccgtcccgtcgccctaaccgacggacgtcccgtacgtcccggtcgggggaccaaccggg

SEQ ID NO: 389323 - DNA, 618 bp, Homo sapiens
  misc_feature: GZ8MTXP02JFSPK.44.23.C01.1.454.CMB.2.raw
  modified_base (269)..(269): a, c, t, g, unknown or other
  modified_base (356)..(356): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcacgccccgagggagggaatggagtggattggtgacntccatagtacgtgggcacgtactactctccgtcctcagacgtcgtctcacctattcgaggacacgtccagtcgaaccccgtcttccnccctagaaactcgacctccgtcgaccgccgcgacacggtcctttattctgtgcgaggcgagacttcggtctttcgaatctagtcggggccgttggctacccgtgtacgactcgtcttcctcgacgtccttaccgaaccgtaacgggtcccctacggttccgggtcccctttcccccggcggtccccgccccgtttcgccccttaacccggaaacggtaccgccccgtaaccgtttccgggtaaccgggggcctaaacccggg

SEQ ID NO: 389324 - DNA, 621 bp, Homo sapiens
  misc_feature: GZ8MTXP02IAYX4.44.23.C01.1.454.CMB.2.raw
  modified_base (400)..(400): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcggaaccctgtctctcatctgcactgtctctggagtttccatcagttctgatcattcgttggggctggactccggcacgcccccgaggggacggggagtgggagtggagttggtgacatccaattatacgtgggcgacgttactactctccgtcctacaacgagtccgtctcactatttcgaggacacgtccatcgaaccgcttccnccctagaacctcgaccctaccgtcgacccggtccgacggaaccgccggtaccgtttactttcgtcggttacggcggtacgggcgtacgggacgtttcgggttacctttactaaactcgttaaggtccgggggtccgtcggtcccgacccgttgggtcctaccgttcgttccctccgtcacgccgttaccaccgacggtccctcgtccgtcccttcccccgg

SEQ ID NO: 389325 - DNA, 626 bp, Homo sapiens
  misc_feature: GZ8MTXP02F6AJQ.44.23.C01.1.454.CMB.2.raw
  modified_base (567)..(567): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggaatgggagtggtagttggtgacactccattatacgtggggcgacgtactactcctccgtcctcaagtagtcgtctcacctattcgaggactacgcatcgaaccccgtcttcctaccctacgaactcgtacccgtccgtacgacccgccgaccggaccgtacggtccgtttatttccgtgtcggcgtaaggcgtaagtacgtggtttcttacgaattcgtacgtcgggggcccgtggacctacccgttcggtacacgttcgtcctctcacgtcctaccgacgaacgggccctacgttccggtacccttcccccgnggcccgtcccctcgacccgttccgaggaccgcccgtaccgtcggacgggggcccaacgg

SEQ ID NO: 389326 - DNA, 559 bp, Homo sapiens
  misc_feature: GZ8MTXP02GVGKM.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggacgggaatggagtggattggtgacatccattatacgtggggcgacgtactactctccgtccctcaacgagtcgtctcacctattcgacgggacacgtccatcgaaccgtcttcctccctagaaactcgaccctccgtcgaccgcccgcggaccacggtccgtttattcgtgtgcgaggcgagacgtggttctttacaatctagtggggtcgtggcctacccgtggtcactcgtctcctctacgccttccgaaccgacggcccacgtccgtccctttcccccg

SEQ ID NO: 389327 - DNA, 561 bp, Homo sapiens
  misc_feature: GZ8MTXP02FULPW.44.23.C01.1.454.CMB.2.raw
  modified_base (349)..(349): a, c, t, g, unknown or other
  modified_base (448)..(448): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggagggaatggagtggattggtgacatccattatacgtgggcacgtactactctccgtcctcaagagtcgtctcaccatttcgaggacacgtcatgaacccgcttcncctgaactcgactccgcgaccgcgccgacacggtcgtttattctgtgcgaggcgagactggtctttacatctagtcggggccgtggcacccgtggtacnctcgtctcctcgtacgccttaccgaccgaacgggtcccagtcccggtccctttcccccgcggtcccgcccgttcgccgtccgacggacgccacccgttcgcgggggcaaccgg

SEQ ID NO: 389328 - DNA, 604 bp, Homo sapiens
  misc_feature: GZ8MTXP02JLWBV.44.23.C01.1.454.CMB.2.raw
  modified_base (318)..(318): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgcccccgagggagggaagtggagtggagttggtgacatcctatatacgtgggcgacgtactactctccgtcctacgagngtcgtctccacctatttcgagggacacgtccatcgaaccccgtcttcctccctagaactgtaccttccgtcgaccgccgcgacgacggtctttacttctgtcgcgaggcgagtactggttctttcgaattcgtagtcggggccgtggcctacccgtgggtcctactcgtcctcctcgacgtcccttaccgaccgtaacgggtccctagtcccggttcccttcccccgtcggtcccgccccttcgccctccgacggtacgccgtaccgtcggtcgggggccaaccgg

SEQ ID NO: 389329 - DNA, 705 bp, Homo sapiens
  misc_feature: GZ8MTXP02HK636.44.23.C01.1.454.CMB.2.raw
  modified_base (241)..(241): a, c, t, g, unknown or other
  modified_base (272)..(272): a, c, t, g, unknown or other
  modified_base (420)..(420): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggngctgttgcctggtttacaacgaaaagggggngacggcccctaaggtcctcgtctctcgtagaaccagactggaaaggtagacgtcccgtcaggttcagtcgccagtccgagggtggtggggaccggacgtccgactctacgaccagttaacgccgtacctggccggtccgtagaaagtntttacctgtacctaaactttactttctcggttacacgtccaagttactactagtaacgttccggtcccccgtttacctaccgtttttacgggacccgtaacgggggaaccctaaggtaccgtaagggtaaaacgttaaccgaaaaaccggtaaaccgtagggttacggaccgtttacggacctaaacccctaattccgttccggttaccttttacctaaccctttccccggttacccccgtacccgttaacttacccgttacgttaaacctttaactttaaaccg

SEQ ID NO: 389330 - DNA, 620 bp, Homo sapiens
  misc_feature: GZ8MTXP02HCSQ8.44.23.C01.1.454.CMB.2.raw
  modified_base (241)..(241): a, c, t, g, unknown or other
  modified_base (275)..(275): a, c, t, g, unknown or other
  modified_base (404)..(404): a, c, t, g, unknown or other
  modified_base (420)..(420): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcaggttcgttttcggngcttgttgccttggtttacaaacgaaaagggggnacggcccctaagggtccctcgtctctcgtagaaacccgagactagggaagtagacgtcccgtcaggttcagtcgcagtccaggtggtgggcccgagtccactctcactatcgcgactgcgcctgaaagnttctgactaaactttnttctgtacacgactaatactactagttacgtccgtccccgtttcttacgtttcggaccgaacgggtaaccaaaggaccgtaaaggaaactaaccgaaaacgtacgttcgggtacgtaccgtacgacctaaacctacgttccgttacgttaccttacctaacctttcccgtaccccgtactacgtcgttaacgtaattacg

SEQ ID NO: 389331 - DNA, 540 bp, Homo sapiens
  misc_feature: GZ8MTXP02IMEHU.44.23.C01.1.454.CMB.2.raw
  modified_base (365)..(365): a, c, t, g, unknown or other
  modified_base (437)..(437): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaatggagtggattggtgacatccattatacgtgggcgacgtactactcctccgtcctcaacgagtccgtctcacctatttcgngggacacgtccatcgaccgcttctcctgaactgacctcgtgaccgccgcgacgacgtcttattcgtgtgcgnggcgagactggtctttcattctagtcgggcgtcggcacccgtgtctacgtcgtcctccgtcacgtcttcccaaccgacggccctacgtcccgttcttcccccg

SEQ ID NO: 389332 - DNA, 584 bp, Homo sapiens
  misc_feature: GZ8MTXP02IXHHR.44.23.C01.1.454.CMB.2.raw
  modified_base (316)..(316): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaatgggagtggattggtgacatccattatacgtggggcgacgtactacctctccgtcctcaagngtcgtctcaccatttcgagggacacgtccatcgaaccccgtcttcctccctagaaactcgacctccgtcgacccgccgcgacacggtccgtttactttcgtgtcgcgtaggcgagacttcggttctttctaatctagtcggggccgtggccacccgtcgggtctaccgtcgtctcctcgtacgtcttaccgaccgacgggccctacgtccggttccttccccgtcggccgccctcgcctccgacggcgccgacctcgtcggggcacgg

SEQ ID NO: 389333 - DNA, 612 bp, Homo sapiens
  misc_feature: GZ8MTXP02IVHDY.44.23.C01.1.454.CMB.2.raw
  modified_base (359)..(359): a, c, t, g, unknown or other
  modified_base (393)..(393): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgccccgagggagggaatggagtggattggtgacatccattatacgtgggcgacgtactactctccgtcctcagagtcgtctcacctatttcgaggcacgtccatcgaaccccgtcttccncctacgaactcgacctccgtcgaccgccgcgacncggtccgtttattcgtgtcgacggaggcgagtacgttggttcctttacaattcgtaggtcggggccgtggccctaccgtggtacctacgtcgttacctcctcgacgtccttacccgacgaacgggtccctagtcccggttcccttcccccggtcggcccgtcccgtacgtccctccggaacggtaccgcctacccggtccgggtcgggggaccaccggg

SEQ ID NO: 389334 - DNA, 607 bp, Homo sapiens
  misc_feature: GZ8MTXP02JE22P.44.23.C01.1.454.CMB.2.raw
  modified_base (241)..(241): a, c, t, g, unknown or other
  modified_base (270)..(270): a, c, t, g, unknown or other
  modified_base (304)..(304): a, c, t, g, unknown or other
  modified_base (397)..(397): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaggggnacggcccctaaggtcctcgtctctcgtgaaaccngactggaagtagacgtcccgtcaggttcagtgccagtccaggtggtgggccccggagtccactctcaccattgcgactggccgcctagaagtnttctgactaacttatttctgtacagctagtatcattacgtcgtcccgtttctacgttttcggccgtaacggggtaccaaaggtccgtagggaaaacttaccgaaaacggtaactcggttacggacctaggacccaacctaacgttccgtacgttcccttaccgtaacttcccgtttacccccgaccttaactccttacgtaactttaacg

SEQ ID NO: 389335 - DNA, 539 bp, Homo sapiens
  misc_feature: GZ8MTXP02F494S.44.23.C01.1.454.CMB.2.raw
  modified_base (451)..(451): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttgggctggatccggcagcccccgagggagggaatggagtggattggtgacatccattatacgtggggcgacgtactactctccgtcctcaacgtagtcgtctcgacatttcgagggacacgtcatcgaacgcttcctcctgaaactgacctcgtcgaccgcgcgacacgtccttattctgtgcgagcgagactgtcttnatctagtgggtcgtggtcacccgtggtctacgtcgtcctcctcgagccttaccaccgtaacggccctacgtccggtcctttcccccgg

SEQ ID NO: 389336 - DNA, 666 bp, Homo sapiens
  misc_feature: GZ8MTXP02JF1Y3.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcattctgatctattcgtgggctggactccgcacgccccgagggagggatggagtggatggtgacatccattagtacgtggggcgtacgtactactctcccgtccctacgaacgtacgtcgtcctctacctacgtttccgaggggtaccaccggttaccagtacgaacccgtccttaccctcccctagaaaaccctcgaacccgttccgtcgaccccgtcccggaccggaccgtaacccgggtccgttttaacgtttccgtggttcgccggtagggtccggtacggtacgttcggggttacctttacgtaacgttccgttagggttcggggtccgttcggtccctacccggtgtcccgtactcggttcctacccgtctacgtccttacccgaccgaacgggtccctaacgttccccggtcctttcccccgg

SEQ ID NO: 389337 - DNA, 592 bp, Homo sapiens
  misc_feature: GZ8MTXP02HD2Y8.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaatggagtggattggtgacatccattatacgtgggcgacgtactactctccgtcctcaagcgtcgtctcacctatttcgaggacacgtccagtcgaaccccgcttcctccctacgaactcgacctccgtcgaccgccgcgacacggtcctttattcgtgtgcgaggcgagtacttggtctttacaatcgtagtcggggccgtggcctaccgtcggtctacgtcgtcctcctactacgtccttccgaccgaaccgggccctacgttcccggttcccttcccccgtcggcccgtccctcgacccgtccgacggacgcccgtaccgtccggcgggggaccaccgg

SEQ ID NO: 389338 - DNA, 721 bp, Homo sapiens
  misc_feature: GZ8MTXP02JL7KU.44.23.C01.1.454.CMB.2.raw
  modified_base (242)..(242): a, c, t, g, unknown or other
  modified_base (277)..(277): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatgacccagtctccttccttcctgtcttcttctgttggagcagcgtcaccatcacttgccgggcgagtcaggttcgttttcggngcttgttcgccttggtttacaaacgaaaagggggngacggcccctaagggtcctcgtctctcgtagaaaccagactgggaaggtagacgtcccgtcaggttcagtcgccagtccgagggtgggtcggccccggtagtccactctcacctagttcgccgtacctggccggtcctaggaaacgtacttcctgtaccttaaaactttcgttttcctcgttactacgtaccgtaagttactaccgtaagtttacgtcccggtttacccccgtttacttaacccggtttttcggggaccccgggtaaacggggggtaaacccctaaacgggtacgttaacgggggtaaaaaccttaccgtaaaaaaccgggtaaccgttagggtacgggtacccttacggacccctaacctaacttaccgttcgttacctttcgtaactttcccctttacccccgctaaccgttccttacggtaactttaaccg

SEQ ID NO: 389339 - DNA, 734 bp, Homo sapiens
  misc_feature: GZ8MTXP02G7DY6.44.23.C01.1.454.CMB.2.raw
  modified_base (287)..(287): a, c, t, g, unknown or other
  modified_base (534)..(534): a, c, t, g, unknown or other
tcagacagtatatacacgaccggtgctcgatttagtacacgtgattagggattgggggagtcagaccctgtcaggggacagcatggacatgagggtcccgctcagctcctggggctcctgctgctctggctcccaggttcgagatgtgacatcgagatgacccagtcctccttccttcctgtcttcttctgttggaggcagcgtcaccatcacttggccgggcgagtcgtagggttcgttttcggtgtcttggttcgccgttgggtttacaaacggtaaaagggggngacggacccctaaggtcctcggtctctcgtagaaaccagacgtgggaaaggtagacgtcccgtcgtaggttcaggtgccagtccgaggtgggtcggccccggagtccacgtctacacctagttcgccgtacgtcggaccggccttaggaaacgtacgtttcctaggtacccttaaacttttacgtttctacgttacgaacggtctaaggttaacttcctaagttaacggtccgttacccccggtttnttaaccggtttttcgggacccgggtaacgggggaaccctaaaggggcgttaaacggggtaaaacttaccgaaaaacgggtaacttgggttacggacgtttacggacccttaaaccgtacgttccgtttacgttccctttaccgtaacctttccccggttaccccgtacctaactttccgttaacggaaactttttaaccg

SEQ ID NO: 389340 - DNA, 650 bp, Homo sapiens
  misc_feature: GZ8MTXP02JCHE7.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggaagtgggagtggattggtgacatccattatacgtggggcgacgtactactctccgtcctacagacgtcgtctcacctatttcgacggacacgtccacgtacgaaccccgtcttacctcctacgaaactcgacctccgtacgaccgtccgcggaccgtacggttccgttttattccgtgttcggcgtacgggcgaaggtacttgggttaccttttacgaattccgtagttcgggggccgttggccctaccgttggtccacgttcgtcctcctcgagtcccttaccgaaccgaacgggtccctaggttcccggtacccgtttcccccgtgggcccctaccccgttcgacccgttccggaacggtcgaccctaacccgtcgggtaccggggaccaaccgg

SEQ ID NO: 389341 - DNA, 646 bp, Homo sapiens
  misc_feature: GZ8MTXP02H63IM.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcggaccctgtctctcatctgcactgtctctggagtttccatctagttctgatcattcgtgggctggatccggcacgcccccgaggacgggatggagtggtagtggtgacgatccattatacgtggggcgtacgtactactctaccgtccctcaacgagtcgtctcactatttcgagggactacgtcctagtcgaacccgcttcctccctagaaacctcgaccctccgcgtaacccgccggaccggaccgtaccgggtccgtttaacttcgttcgttacggcggtaacggcgtacggaaccgtttgggtacctttacgaaactcgttaaggtcggggtccgtcgggtcctaccccggttggtaccctacgttcggttcccgtcccttcgaacggtcccttacccaaacccggacggggtacccctaacgttcccgggttacccctttccccccggg

SEQ ID NO: 389342 - DNA, 582 bp, Homo sapiens
  misc_feature: GZ8MTXP02JVRLJ.44.23.C01.1.454.CMB.2.raw
tcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtcctctcatctgcactgtctctggagtttccattcagttctgatctattcgtggggctggatccggcacgcccccgagggacgggaagtggagtggtagttggtgacagtccattagtacgtggggcgacgttactactctcccgtcctacacgagtcgtcgtacacctagtttcgaggaccacgtccatcgaacccgcttaccgtccctagaaactcgaccctcgtcgaccgccgcgacacggtccgtttacttcgtgtcgcggagcgagtactcggttcttagaatcgtagtcggggcgtcggcctacccgtggtcctactcggtcctccgtctacgcctttaccacgtacggccctacgttccggtcctttcccccg

SEQ ID NO: 389343 - DNA, 552 bp, Homo sapiens
  misc_feature: GZ8MTXP02ITVWX.44.23.C01.1.454.CMB.2.raw
  modified_base (241)..(241): a, c, t, g, unknown or other
  modified_base (271)..(271): a, c, t, g, unknown or other
  modified_base (307)..(307): a, c, t, g, unknown or other
  modified_base (399)..(399): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcaggttcgttttcggngctgttgcctggtttacaacgaaaaggggngaggacccctaaggtcctcgtctctcgtagaaaccngactggaaggtagagtccccgtcaggttcagtgccagtccaggtggtgggcccgagtccactctcaccatgcgactgcgcctagagtattcngctaacttattctgtcagctaagtatcatagtcgtccccgttatctttggccgtagggggacccaagcttaaggaaaactcgaaaacgtacgtggttaggccttagccaaccattctacgtctttcaattccttcccgactatctatacttaa

SEQ ID NO: 389344 - DNA, 749 bp, Homo sapiens
  misc_feature: GZ8MTXP02JF9HY.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccattcagttctgatctattcttggggctggatccggcagcccccgagggacggggaatgggagtggagttggtgacagtccattagtacgtggggccgtacgtactacctctccggtcccctcaaacgtagtaccggtctaccgtaccgtaactttcggaggggtacctacggttcccaagtcgaaacccggtccttcgtaccccctggtaaaaccttcgtaacccgttcccggtcgaaccccgcccggaccggtaacccgaccggggttacccgttttaacgtttccgttcggtttggccggttaacgggccgtaacgggtaaccttcggggttcccttttaacgaaaaccgtttcgttaacggttcgggggtaccccgtttaggggccccttaccccgttacggggtcctaaccgttcggttacccttaccccgtcgtaaaccgggtcctttacccgaaccccgtaaaacgggggtccccctaacgttccccggggttacccttttcccccccggg

SEQ ID NO: 389345 - DNA, 837 bp, Homo sapiens
  misc_feature: GZ8MTXP02FWKGY.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacgccccgagggagggatgggagtggtagttggtgactataccattacgtacgtgggacgacgtacctactcctcccgtccctagaacgtacgttccgtcctaccgaacctacgtttaccggaacggggtacctaccggtacctaacgttaccggtaaacccccgtccctttaccccgtaccccgttaacggtaaaacccttccggaacccccgtttcccgggtaccgaacccccgggcccggacccgggtaacccgtaccgggtttacccgtttttacgtttccgtcggttcggaccgggtacgggacgtaacggttaccgttggtttacccttttacgaaacgttacgtacggtcgggggtcccgttcgggtaccctaccccggttgggttaccctacgttccggttccttcccgtaccgtacggttccccttaacccgaaacccgggtaaaaccggggtcccccttacggttccccgggtttacccccttaccccccggtcgggtcccccgtcccccgtcggtccccgttaacccggaaaccggggtcccgtaccccgtaaccccggtttaccgggccgggggtacccaaacccgggg

SEQ ID NO: 389346 - DNA, 651 bp, Homo sapiens
  misc_feature: GZ8MTXP02GXN2D.44.23.C01.1.454.CMB.2.raw
  modified_base (401)..(401): a, c, t, g, unknown or other
  modified_base (592)..(592): a, c, t, g, unknown or other
tcagacagtatatacacgaccggtgctcgatttagtacacgtgattagggattggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtacgtttccatctagttctgtatctattcgttggggctggatccggcacgcccccgaggggacggggaagtgggaggtggagtttcgggtgacgatcctaagttactacgtggggacgtacggttaacttactcctccgtccccctacgaagtacgtccgtctccacccgtntttccggaagggacctaccgtccaatcggaaacccgtccttacctccccgtagaaaccgttcgacccttcccggtcgaacccggcccgcggacccgtacggtcccgttttatttccgtgttcggcgagggcgtaagccgttggttacttcgaatccgtaggtcggggtccgttggccctaccgtgggtccncgtcgttcctctccgtacgtccttacccgaaccgaaccgggtccctacgtttcccccgg

SEQ ID NO: 389347 - DNA, 584 bp, Homo sapiens
  misc_feature: GZ8MTXP02GJZ9C.44.23.C01.1.454.CMB.2.raw
  modified_base (413)..(413): a, c, t, g, unknown or other
  modified_base (540)..(540): a, c, t, g, unknown or other
  modified_base (560)..(560): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttgggctggatccggcacgccccgagggagggaagtggaggtggagttggtgacatcatatacgtgggacgacgtactactctccgtcctcaagagtcgtctcactattcgaggacacgtcatcgaaccccgtcttcctcctagaactcgacctccgtcgacccgccgacgaccgtacggtaccgtttattccgngtcgcgaggcgagtacgtggttaccttcaatcgtagtcggggccttggcctaccgtgtaccagtcgtcctacctcagtcccttacgaaccgacggccctacgtccggttcccttccccctgggcccncccgttcgccctcgacggcncccgacgtccggcggggaccacgg

SEQ ID NO: 389348 - DNA, 636 bp, Homo sapiens
  misc_feature: GZ8MTXP02FXZN4.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatcagttctgatctattcgttggggctggatccggcacgcccccgaggggacggggaatgggagtggatttggtgacatccattatacgtgggcgtacgtactactcctccgtcctacaacgtagtccgtctcactatttcgacggacacgtccactcgaaccgtcttacctccctagtaaaccgtcgaaccctccgtacgacccgccggcggaaccgtaccgggttacccgtttagtttccgttggtcggacgggtacggccgtaacggtacgttcgggttacctttataacgttcgtaggtcggggtccgtacgggcctaccggtggtacctacgttcgtcctccctacgacgtccttaccgaccgacgggtccctacgtccgttcccgtttcccccgg

SEQ ID NO: 389349 - DNA, 631 bp, Homo sapiens
  misc_feature: GZ8MTXP02H4QX7.44.23.C01.1.454.CMB.2.raw
  modified_base (584)..(584): a, c, t, g, unknown or other
  modified_base (628)..(628): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctatttcgttggggctggactccggcacgccccgagggagggagtggaggtggagttggtgacatcctattagtacgtggggacgtacgtactacctcctcccgtcctcaagacgtcgtctcacctattcggaggacacgtcagtacgacccgtcttcctacctacgaactcgacctccgtcgaccgccgacgaccgtacggtcctttattcgtgtgacggtacggacgtagtacgttcggttctttacaacgttcgtacggtcggggaccgtcggaccgtcccgtggtcctacgtcgtccctcgtccgtacgtccctaccgaaccgtaaccgggtccctacgttcccggtcccttcccccgcggtcccncccgtgccctccgacggaccgccgtaccgtccgggcggggaccncgg

SEQ ID NO: 389350 - DNA, 649 bp, Homo sapiens
  misc_feature: GZ8MTXP02JFFXM.44.23.C01.1.454.CMB.2.raw
  modified_base (300)..(300): a, c, t, g, unknown or other
  modified_base (340)..(340): a, c, t, g, unknown or other
tcagacagtatatacacgaccggtgctcgatttagtacacgtgattagggattgggggctttctgagagtcaaggacctcctgtgcaagaacatgaagcacctgttggttttttcctcctgctggtggcagctcccagatgggtcctgtcccaggtgcagctgcaggagtcgggccaggactggtgaggccttcgggaaccctgtctctcatctgctactgtctcgtggtatttccatctagttctgatctattcgttgggctggatccggcacgcccgagggaggatggagtgagtggnacatctatatagtgggacgacgtactactctccgtcctanaacgagtcgtctactactacgttcgacgggacacgtaccagtacgaaacgtccttacctacccgtaagtaaacctcgacccgttccgtacgacccgacccggacggaaccgtacggttacgtttaacgtttcgtcgttcgcggaacgggtcgtaacggtacgttcggttacgtttaactaacgttacgtaacggttcggggaccgtcgggtacctaccgtcgtaccgtacgtcgttacctccgtacctacggtaaccttacccgaaaccgaccgggtaccctacggttcccgttacccgtttcccccgg

SEQ ID NO: 389351 - DNA, 615 bp, Homo sapiens
  misc_feature: GZ8MTXP02IWO8V.44.23.C01.1.454.CMB.2.raw
  modified_base (308)..(308): a, c, t, g, unknown or other
  modified_base (510)..(510): a, c, t, g, unknown or other
  modified_base (579)..(579): a, c, t, g, unknown or other
tcagacagtatatacacgaccggtgctcgatttagtacacgtgattagggattgggggctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttgggctggactccggcacgccccgaggggacgggaatgggaggtggagtttggnggactagtcctaagttataacggtggggaccgtacggtactacctccttcccgtccctacgaacgacgttccgtctccgaccctagtttccggaggggtactaccggtcccattcgaaccgtccttcctaccctagtaaaccttcaacccgtcgtcgacccgcccggacgaccgtaccgggttccttattcgtcgtgacggngccgagtactggttcttcgaatcgtagtggggcgttagccctacgttggtcacgttcgtcctcctacgngtccctccacgacggacctcgtccgttccctcccgg

SEQ ID NO: 389352 - DNA, 600 bp, Homo sapiens
  misc_feature: GZ8MTXP02IK755.44.23.C01.1.454.CMB.2.raw
  modified_base (221)..(221): a, c, t, g, unknown or other
  modified_base (240)..(240): a, c, t, g, unknown or other
  modified_base (273)..(273): a, c, t, g, unknown or other
  modified_base (413)..(413): a, c, t, g, unknown or other
  modified_base (428)..(428): a, c, t, g, unknown or other
  modified_base (564)..(564): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccggngagtcaggtcgttttcggngctgttgccttggtttacaaacggaaaaggggngacggacccctaaggtcctcgtctcgtcgtagaaaccagacgtaggaaggtagcgtacccgtcgaggttcagtcgccagtccgagggtggtcgggccccggagtccactctacaccattcgcactggccgcctagaagtntctgactaaactttntttccgtagtcctaggtactagttaatactaagttacgtccgttacccccgtttacttacgtttcggacccggtaagggggaaccctaaggccttaagggaaacttaccgaaaacgactggtagctagctaacctntctacttctactcgttcctccgactatctactatac

SEQ ID NO: 389353 - DNA, 548 bp, Homo sapiens
  misc_feature: GZ8MTXP02FOIFP.44.23.C01.1.454.CMB.2.raw
  modified_base (405)..(405): a, c, t, g, unknown or other
  modified_base (408)..(408): a, c, t, g, unknown or other
  modified_base (410)..(410): a, c, t, g, unknown or other
  modified_base (416)..(416): a, c, t, g, unknown or other
  modified_base (419)..(419): a, c, t, g, unknown or other
  modified_base (531)..(531): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcgagggttcgttttcggtgcttggttcgccttgggtttacaaacgtaaaaagggggagacggcccctaaaggtcctcgtctctcgtagaaaccagactgggaagtagacgtcccgtcaggttcagtgccagtccaggtggtggccccggagtccatctcaccatcgcactgcgctgatntcngntacttnttntgtcagcagtatcattacgtcgtcccgttctacgtttcgaccgtagggaccaagcgtagaaactacaaacgagtgtacggctagcacatcgtctcttcaattcccgtacccnctactctacgtacttaa

SEQ ID NO: 389354 - DNA, 616 bp, Homo sapiens
  misc_feature: GZ8MTXP02F9OZ1.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggaatggagtggagttggtgacatctattagtacgtgggacgacgtactactctccgtcctacagagtcgtctcacctatttcgaggacacgtccatcgaaccccgtcttcctacctagaaactcgtacctccgtacgaccgccgacgaccgtacggtccgtttattcgtgtcgcgaggcgagtacttcggttctttacgaattcgtaggtcggggaccgtggtcccgtacccgtgggtacctacgttcgtcctacctcgacgtccttaccgaccgaacggtccctagttcccggttcccttcccccgtgggcccctccgtcgcccgtccgacggtaccgaccgtccgttcggccgggggcaaccgg

SEQ ID NO: 389355 - DNA, 767 bp, Homo sapiens
  misc_feature: GZ8MTXP02ITQ1Y.44.23.C01.1.454.CMB.2.raw
  modified_base (240)..(240): a, c, t, g, unknown or other
  modified_base (274)..(274): a, c, t, g, unknown or other
  modified_base (310)..(310): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcaccatcacttggccggcgagtcaggttcgttttcggngctgttgccgttggtttacaaacgaaaagggggnacggacccctaaggtcctcgtctctcgtagaaaccngacgtgggaaagtagacgtcccgtcaggttcagtgaccaggtccgagggtcggtcgggccccggtacgtccacttctcaaccgtagttaccggccgtaacccgttgggacccggtaccgtaggaaacgttactttaccgtcgtaaaccttaaacgttttacttttaccgtcggttaaccagggtacctaaaggtttactaccgtaagtttaaccggttcccggttaccccccggttttaagtttaccggtttttaccgggggacccccggtaaaggggggtaaacccctaaaaggttccggttaaagggtaaaaccgtaaccgtaaaaaacccggtacgttacggggttacggaccttccggtaacccgtaaaccctagtttacccgtttcggttacctttacctaaccgtttaccctttcccggaccccttaagttccctaagttaactttaaacg

SEQ ID NO: 389356 - DNA, 684 bp, Homo sapiens
  misc_feature: GZ8MTXP02JZAOR.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgatctattcgttggggctggacgtccggcacgccccgagggagggaagtggagtggtagttggtagacgtatcctaagttagtacggtggggaccgtaacgtactacctccgtccccgtccctacgaaccgtacgttccgtctacctactagttcggacggacacgtacctagtacgaaccgtcttcctaccctacgtaaactcgacctccggtcgacccggccggaccggaccgtaccggttccgtttacgtttccgtggttacggacggagggtaccggacggttacgttcgggtttaccttaacgttaacgttacgttacggtccgggggtccgtcgggtacccgtacccggttcgtaccgtcgttcgtcccttccgtctacggtcccttacccgaaccgtaccgggaccctcggttcccgtccccgtttcccccg

SEQ ID NO: 389357 - DNA, 553 bp, Homo sapiens
  misc_feature: GZ8MTXP02IF3G1.44.23.C01.1.454.CMB.2.raw
  modified_base (240)..(240): a, c, t, g, unknown or other
  modified_base (269)..(269): a, c, t, g, unknown or other
  modified_base (542)..(542): a, c, t, g, unknown or other
  modified_base (549)..(549): a, c, t, g, unknown or other
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaggggnaggcccctaaggtcctcgtctctcgtagaaaccagactggaagtagacgtcccgtcaggttcagtcgccagtccaggtggtgggccccggagtccgactctcaccattcgcgactggcggcctaggaagtacttcgtgcctaaacttatttctgtcagtcagtatcatagtcgtaccccgtttctacgttttcggaccgtaacggggacccaaaggctaggaaactacgaaaacgaactgtacggctgacaccatctcgttctcaactctccnctatctnacta

SEQ ID NO: 389358 - DNA, 798 bp, Homo sapiens
  misc_feature: GZ8MTXP02FV08D.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgcccccgagggacggggaatgggagtggagttggtgacatccattatacgtggggcgacgtactactcctccgtcctacaacgacgtcgtctcacctatttcggacggggtacaccggttaccaacgtacgaaacccgtcctttaccctccccgttaacggtaaaaccttacgtaaccccttcccggttacgaaacccccgggccccgggtaacccggggtaacccccgtaaccggggttacccccgtttttaacgttttacccggttacggtttccgggaccggtaacgggggtacccggtaacggtaaccggtttccggggtttaccctttttaacggtaaaacgtttccggtttaaacggtccggggggttacccgttaccggggtccccgttaacccccggtttggggtacccctacgtttccggttcccgttacccttcgtaccgtaacccgtttacccctaacccggaaaccggggcccccttaaccggttccccggggttacccccttttcccccccggg

SEQ ID NO: 389359 - DNA, 588 bp, Homo sapiens
  misc_feature: GZ8MTXP02ISFMT.44.23.C01.1.454.CMB.2.raw
  modified_base (354)..(354): a, c, t, g, unknown or other
  modified_base (410)..(410): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggagttggtgacatccattatacgtggggcgacgtactactctccgtcctcagagtcgtctcacctatttcgaggacacgtcatcgaacccgcttcncctgaactcgacctccgtcgaccgccgccgacgacggtccgtttattcgtgtgcgnggcgagactggtcttacattcgtagtcggggccgtggcctacctgggtcactgtcctctcagtccttccaccgaacgggtccctacgttccggtccctttcccccgtcgggtccccgtccccgttcggcccttcccgacggtaccgcccgtacccgtccggtcgggggaccacccggg

SEQ ID NO: 389360 - DNA, 592 bp, Homo sapiens
  misc_feature: GZ8MTXP02G1ZYL.44.23.C01.1.454.CMB.2.raw
  modified_base (244)..(244): a, c, t, g, unknown or other
  modified_base (389)..(389): a, c, t, g, unknown or other
  modified_base (415)..(415): a, c, t, g, unknown or other
  modified_base (419)..(419): a, c, t, g, unknown or other
  modified_base (428)..(428): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcagggttcgttttcggngtcttgttgccttggtttacaaacggaaaaggggagacggaccccgtaaggtcctcgtctctcgtagaaaccagacgtaggaaggtagacgtcccgtctaggttcagtcgccagtccgagggtggtgggccccggagtccactcncaccattcgcgactgcgcctgaagtnttcnactaatttnttctgtcagcagtatcatacgtcgtccccgtttactacgtttcggaccgaggggaaccctaaggcgtaggaaaactaccgaaaacgtactggtacgtcgtagaccactacttcctcgttcctttacaacttcccgttaccccactacttacctagtaactttaa

SEQ ID NO: 389361 - DNA, 591 bp, Homo sapiens
  misc_feature: GZ8MTXP02JPW06.44.23.C01.1.454.CMB.2.raw
  modified_base (353)..(353): a, c, t, g, unknown or other
  modified_base (377)..(377): a, c, t, g, unknown or other
  modified_base (493)..(493): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgatctattcgttggggctggactccggcacgccccgaggggacgggaatggagtggagtggtgacatccattagtacgtggggcgtacggtactactcctccgtcctanaacgtagtccgtctcactattcgngggtaccacgtccacgtgaaccgtcttcctccctagaaacctcgaccctcgtacgcccgccggcgacgtacgtccgtttacttcgtcgtcggtcggaggcgacggtacgtcggttntttaccgtaatcgtagtcggggtccgcggtcctaccgtgtcctcgtcgtctaccctcgactcctaccgaccgacggccctacgtccgttcctcccccg

SEQ ID NO: 389362 - DNA, 655 bp, Homo sapiens
  misc_feature: GZ8MTXP02JP5JF.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggacggggaatgggaggtggtagttggtagacagtccattatacgtggggacgtacgtactactctcccgtcctcaagacgtcgtctcacctatttcgaggaccacgtccatcgaaccccgtcttctccctacgaaactcgacctccggtcgacccgccgaccgacgtaccggtccgtttacttcgtcgtagtcggacggcgtacgtacgttcggttctttacgtaacttcgttacggtcgggggtcccgttgggacccgtacccgtcggtaccgtacgttcgtccgttcctcgacgtccttaccgacccgtaacggtaccctcgttcccggttcccttcccccggtcggtcccgtcccgtcggccctccggacggacgtccgtccggtccggtcgggggccaaccggg

SEQ ID NO: 389363 - DNA, 612 bp, Homo sapiens
  misc_feature: GZ8MTXP02FWHIH.44.23.C01.1.454.CMB.2.raw
  modified_base (415)..(415): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaagtgggagtggagttggtgacgatccattatacgtgggacgacgtactactctccgtcctacaagacgtcgtctcactattcgaggacacgtcatcgaaccccgtcttcctacctagaactcgacctcgtcgaccgccgacgacacggtccgtttatttcgngtcgcgacggcgagtactcggttacttacgaatcgtagtcgggggccgtggcctaccgtgtctactcgtctctcgtacgtccttaccgacgaaccggtccctacgttcccgggttccccttccccgtcggtccccgtacccgtcgccccgtaaccgacgggaaccgccgtacccgttcggacgggggaccaaccggg

SEQ ID NO: 389364 - DNA, 602 bp, Homo sapiens
  misc_feature: GZ8MTXP02FQB2A.44.23.C01.1.454.CMB.2.raw
  modified_base (411)..(411): a, c, t, g, unknown or other
  modified_base (415)..(415): a, c, t, g, unknown or other
  modified_base (444)..(444): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttcgtcctggtttacaaacgaaaagggggagacggcccctaaggtcctcgtctctcgtacgaaaccagactaggaaggtagacgtccccgtcgaggttcaggtgccagtccgagggtggtcgggccccgagtccactctcaccattcgcactgccgctgaagtnttcngtactaactttatttctgtcagtcagtanacatagtctccccttcgtacgtttcggaccgaacggggtacccaaggtcgtaaggaaaactacgaaaaccgtacgtaggtcgtactaggacctaacctacttcctacggttccttctaacgttcccttaccccgtcctaacttcctagtaactttaac

SEQ ID NO: 389365 - DNA, 622 bp, Homo sapiens
  misc_feature: GZ8MTXP02FQZSU.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacggccccgagggaggggaatgggaggtggagttggtgacatccattatacgtggggcgacgtactactctccgtcctcaagagtccgtctcacctatttcggagggacacgtcatcgaaccccgtcttcctaccctagaaacctcgaccctccgtacgacccggtccgacggaccgtacggtaccgttttactttcgtgtcggcgtaggcgagtacgtggttctttcaatctagtcggggtccgtggtccacccgttggtacctacgttcgtcctcctcacgtcctaccaccgaacgggccctacgttcccggttcccgttccccgtcggtcccgtcccgtcggcccttccgacggacgccgtacccgtcggtcgggggacaccgg

SEQ ID NO: 389366 - DNA, 612 bp, Homo sapiens
  misc_feature: GZ8MTXP02I2L4H.44.23.C01.1.454.CMB.2.raw
  modified_base (490)..(490): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgatctattcgttggggctggactccggcacgccccgagggacggaagtggagtggagttggtaggactaagtcctaattacgtaacggtggggacgtacggtaacttacctcctccgtcctacaacgacgtcgtctcacacgtttacgagggacacgtccagtcgaaacctgttacctaccctagaaactcgacctcgtacgaccgccgtacggacgtaccggtcgtttattcgtgtcgacggngacgagtacgtcgtcttacaagtcgtagtcggggccgtcgtaccgtacccgttcggactacgtcggtcctacctcgaagtcccttaccgaaccgacggccctacggtccgtcccttccccgg

SEQ ID NO: 389367 - DNA, 544 bp, Homo sapiens
  misc_feature: GZ8MTXP02I08VD.44.23.C01.1.454.CMB.2.raw
  modified_base (502)..(502): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgtggggctggatccggcacgcccccgagggagggaatggagtggagttggtgacatccattatacgtggggcgtacgtactactctcccgtcctcaacgacgtcgtctcactatttcgagggacacgtccatcgacgtcttctacctgaaactgacctcgtcgaccgccgcgacacgtcgttacttcgtgtgcgaggcgagtactggtcttacatctagtcgggcgtgcaccgtggtcacgtcgtctccgtnacgtccttcccacgacggcccacgtccgtcccgtttcccccg

SEQ ID NO: 389368 - DNA, 611 bp, Homo sapiens
  misc_feature: GZ8MTXP02GRFR5.44.23.C01.1.454.CMB.2.raw
  modified_base (273)..(273): a, c, t, g, unknown or other
  modified_base (359)..(359): a, c, t, g, unknown or other
  modified_base (410)..(410): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgtctgttgccttggtttacaaagaaaagggggngacggcccctaaggtcctcgtctctcgtagaaaccagactggaaggtagacgtcccgtccaggttcagtcgccagtccagggtggngggccggacgtccactctcacctattacgccgacctggccggcctagaagnttctagctaaactttattctgtcagcagtatctagtacgtcgtccccgttctacgttttcggccgtacgggggtaccaaacgcgttaggaaactaccgaaaacgtaacgtggtacggacgtcgacctacccgtaattccttcgttaccttacctacttcccgtttaccccgacctacttccgtacgtaacttactttaacg

SEQ ID NO: 389369 - DNA, 552 bp, Homo sapiens
  misc_feature: GZ8MTXP02GALVE.44.23.C01.1.454.CMB.2.raw
  modified_base (301)..(301): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggattggngacatccattatacgtgggcgacgtactactctccgtcctcaagacgtcgtctcacctatttcgagggacacgtccatcgaaaccgcttctccctagaaacctcgaacctccgtgacccgccgcgacacggtccgtttatttcgtgtgcgtagcgagactggtcttacaatctagtcggggcgtcggctaccgtggtcacttcgtcctcctcagtccttaccacgaacggcccagtccggtccttcccccg

SEQ ID NO: 389370 - DNA, 576 bp, Homo sapiens
  misc_feature: GZ8MTXP02IKGN2.44.23.C01.1.454.CMB.2.raw
  modified_base (442)..(442): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggccaggactggtgaggccttcgggaaccctgtctctcatctgcactgtctctggtagtttccatcagttctgatctattcgttggggctggatccggcacgccccgagggagggatggagtggagttggtgacatccattatacgtgggacgacgtactactctccgtcctcaacgacgtctctcactactttcgacgggtacacgtccatcgaacgtcttcctcctagaactcgacctcgtcgaccgccgcgacacgtcgttacttcgngtgcgtagcgagtactggttacttcgaatcgtagtggggaccgtcggacctaccgtggtcctacgtcgttcctccgtacacgtccttaccgaaccgtaaacgggtccctacggttccgtacccgtttcccccgg

SEQ ID NO: 389371 - DNA, 575 bp, Homo sapiens
  misc_feature: GZ8MTXP02IOKRQ.44.23.C01.1.454.CMB.2.raw
  modified_base (371)..(371): a, c, t, g, unknown or other
  modified_base (378)..(378): a, c, t, g, unknown or other
  modified_base (453)..(453): a, c, t, g, unknown or other
  modified_base (464)..(464): a, c, t, g, unknown or other
  modified_base (535)..(535): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgtgggctggatccggcacgccccgagggacgggatggagtggagttggtgacatccattatacgtggggacgtacgttactactcctccgtccctcaacgtgtcgtctcactagttcgngggtacncgtccagtcgaaccgtcttcctccctagaaacctgaccctccgtcgacccgccgacgacgtcggtctttacttcngtcgcgtaggngagtacgtggttacttacgtattcgtagtcggggtcgcggtcctaccgtggtcctacgtcgtcctccgtcncgccttccaccgtacggcctacgtccggttcctcccccgg

SEQ ID NO: 389372 - DNA, 682 bp, Homo sapiens
  misc_feature: GZ8MTXP02HCG2B.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacggccccgagggagggaagtgggaggtggagttggtgacatcctattatacgtgggacgacgtactactctccgtcctacagcgtcgtctcacctagttcgacggactacgtaccatacgaaccccgtctcctccctacgaactcgacctccgcgacccgccgcgacctacggtcgtttacttctgtgcggaggcgacgtacgttcggtactttacaacgttcgtaaggtccgggggtccgtcgggtaccctacccgttgggttaccaccgttcggttcccttcccgtaccgtacgttcccttacccgaaaccgtaaccggggtcccctacggtttccccgggttcccctttcccccggtccgggccccgtaccccgttcggcccgttaacccggacgggtaccgtcccgtaccggtccgggtccgggggaccaacccgggg

SEQ ID NO: 389373 - DNA, 628 bp, Homo sapiens
  misc_feature: GZ8MTXP02HYNKG.44.23.C01.1.454.CMB.2.raw
  modified_base (219)..(219): a, c, t, g, unknown or other
  modified_base (240)..(240): a, c, t, g, unknown or other
  modified_base (275)..(275): a, c, t, g, unknown or other
  modified_base (305)..(305): a, c, t, g, unknown or other
  modified_base (311)..(311): a, c, t, g, unknown or other
  modified_base (430)..(430): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgtggagcagcgtcaccatcacttgccgggngagtcagggttcgttttcggngtcttgttgccttggttacaaacggaaaagggggnacggacccctaaggtcctcgtctctcgtanaaaccngacgtagggagtagacgtcccgtcgaggtcagtcgccagtccgagggtgggtcgggccccggagtcccactctcaaccgtattacgccgtaactcggccggaccttaggaaagtcttcncgactaactttactttcctgttacacgctagtaactcaagttacggtccgttcccccgttacgttaccgttttcgggaccggaacggggtaacccaaggtcgtaaggaaaactaccgaaaaccgaacgttcggacggctacgaccacctacttcctacgttctactaacgttccctacccgacactctacgtactaac

SEQ ID NO: 389374 - DNA, 604 bp, Homo sapiens
  misc_feature: GZ8MTXP02GK9DW.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatgggagtggattggtgacatccattatacgtgggcgacgtactactctccgtcctcaagagtcgtctcacctatttcgaggacacgtccatcgaaccccgcttcctccctacgaactcgacctccgtcgacccgccgccgaccacggtccgtttattcgtgtcgcgaggcgagtacgtcggttctttacaattcgtagtcggggccgtcggcctaccgtcgggtccacgtcgtcctcctcgacgtccttccaaccgaacgggccctacgttccggttcccttcccccgtcggccccgtcccgtcgcctaacccgtacggaccgccgacccgtcggtcgggggcaaccgg

SEQ ID NO: 389375 - DNA, 629 bp, Homo sapiens
  misc_feature: GZ8MTXP02FO6OA.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacggccccgagggagggaatggagtggagttggtgacagtccattagtacgtggggacgacgtactactcctccgtcctacaagacgtcgtctcacctagttcggacgggactacgtcactacgaaccccgtcttcctacctacgaactcgaccctccgcgacccgcgaccgacacggtctttattctgtcgcggagcgagtacgtggttcttacattcgtagtcggggtccgtcggtcctaccgtcggtctacgtcgtcctcctcgacgtccttacccgacgaaccggtccctacgttcccggttccccttccccggtcggccccgtccccgtcgtccccgtaaccgacggtaccgacccgtacccgtccggtacgggggccaacccggg

SEQ ID NO: 389376 - DNA, 540 bp, Homo sapiens
  misc_feature: GZ8MTXP02FGCKV.44.23.C01.1.454.CMB.2.raw
  modified_base (363)..(363): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccaggaggggaatggagtggattggtgacatccattatactggggcgacgtactactctccgtccctcaacgagtcgtctcaccatttcgngggacacgtccatgaacgtcttctccctgaaacctgacctcgtgaccgccgcggacacggtcctttatttctgtgcgagcgagactggtctttacaatctagtggggtccgtggcctacccgtggtcactcgtctcctcacgcttccaccgaacggcccactccggtccttcccccg

SEQ ID NO: 389377 - DNA, 617 bp, Homo sapiens
  misc_feature: GZ8MTXP02GKFRL.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttgggctggactccggcacggccccgagggaggggaagtgggaggtggtagttggtagactatcctaattagtacggtggggacgacgtactactcctccgtcctacgaagtcgtcgtctctactattcggacggacacgtcatacgaaccccgtcttcctacctagaactcgacctccgtcgaccgccgaccgacgtacgtctttattctgtcgcgagcgacgtactgttcttacattctaggtcgggtccgtgcctaccgtgtccacgtcgtctcctacgtacgtccctaccgaaccgaacggtccctacgttcccggttcccttcccccgtcggccccgtacccgtcgacccgtccgacggccacccgtaccgtcggacggggaccaccggg

SEQ ID NO: 389378 - DNA, 593 bp, Homo sapiens
  misc_feature: GZ8MTXP02FVWZH.44.23.C01.1.454.CMB.2.raw
  modified_base (241)..(241): a, c, t, g, unknown or other
  modified_base (435)..(435): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttcngatctattcgttgggctggatccggcacgccccgagggagggaatggagtggattggtgacatccattatacgtggggcgacgtactactctccgtcctcaacgacgtcgtctactacctactttcggacgggacacgtccacgtcgaaccgtcttcctccctagaaactcgaacctcgtcgaccgccgcgacncgtcgttattctgtcgcgaggcgacgtacgttcgtctttacgaacttcgtacgtcggggtccggtcggtccgtacccgtcggtctacgttcggtccttcctcgtacgtccgttacccgaaccgtaaccggccctacgtcccggtcccgtttcccccgg

SEQ ID NO: 389379 - DNA, 564 bp, Homo sapiens
  misc_feature: GZ8MTXP02JTMD0.44.23.C01.1.454.CMB.2.raw
  modified_base (358)..(358): a, c, t, g, unknown or other
  modified_base (396)..(396): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccccgagggaggggaatgggagtggattggtgacatccattatacgtggggcgacgtactactctccgtccctcaacgagtcgtcncacctatttcgagggacacgtccatcgaaccgcttccnccctagaaactcgacctcgtcgaccgccgcgacaccggtcctttattctgtgcggtaggcgagtactggttcctttacgaatcgtagtcgggcgtggcctaccgtggtcacgttcgtcctccgtcacgtccttccgacgacgggcccacgtccggtcctttcccccgg

SEQ ID NO: 389380 - DNA, 566 bp, Homo sapiens
  misc_feature: GZ8MTXP02GKOZN.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccgagggagggaatggagtggagttggtgacatccattatacgtggggacgacgtactactctccgtcctacaagagtcgtctcaccatttcgaggacacgtccatgaaccccgcttctccctagaaactcgacctccgtcgacccgccgccgacacggtcgtttattctgtgcgaggcgagactgtctttcaatctagtcggggccgtggcacccgtggtccacgtgtcctcctcacgtccttaccaccgaacggcccacgtccggttccttccccgtcggcccgtccctgccctccgacgacgcaccgtcggcgggggcaaccgg

SEQ ID NO: 389381 - DNA, 639 bp, Homo sapiens
  misc_feature: GZ8MTXP02F6C2S.44.23.C01.1.454.CMB.2.raw
  modified_base (241)..(241): a, c, t, g, unknown or other
  modified_base (273)..(273): a, c, t, g, unknown or other
  modified_base (310)..(310): a, c, t, g, unknown or other
  modified_base (410)..(410): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngctgttgccttggtttacaaacgaaaaggggngacggcccctaaggtcctcgtctctcgtagaaaccgngactggaaggtagacgtcccgtcaggttcagtcgccagtccgagggtcgggtcgggcccggagtccactcgtcaccattcgccgactggccgctagaatnttctgactaactttatttctgtacagctagtatcagttacgtccgtccccgtttactaccgtttcggaccgtacgggggaacccaagtaccgtaagggtaaaactacgtaaaacggaccgttggtacgggtacctcggacctaaaccctacgtttccgttacgttccctttacctaaccgttcccccgtttacccccgaccttacgttaccttacgtaattttaaaccg

SEQ ID NO: 389382 - DNA, 632 bp, Homo sapiens
  misc_feature: GZ8MTXP02IPW3Z.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacgccccgagggagggatggagtggattggtgacatccattatacgtgggcgacgtactactcctccgtcctcagagtcgtctcacctatttcgaggacacgtccatcgacccgtcttcctccctagaaactcgacctccgtcgacccgcccgaccgaccgtacggtccgttttattctgtcgcgaggcgtagtacgttcggttctttacgaattcgtagtcgggggtcccgttggcctacccgttgggtccaccgttcgttccttcctcgtacgtccttacccgaccgaacgggtccccacgtttcccgggttcccctttcccccgcgggtccccgtccccgttcgcccgtcccgacggaccgtcccgacccgtccggtcgggggaccaaccggg

SEQ ID NO: 389383 - DNA, 612 bp, Homo sapiens
  misc_feature: GZ8MTXP02IYBSB.44.23.C01.1.454.CMB.2.raw
  modified_base (365)..(365): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaatggagtggattggtgacatccattatacgtggggcgacgtactactctccgtcctcaacgagtcgtctcaccatttcgngggacacgtccagtcgaaccgtcttcctccctagaaacctcgaccctccgtgacccgccgcggacctaccgggtccgtttattccgtggttcgcggaggccgaaggtaccgttcggttccttttacgaattcgttaggtcgggggtccgtggtcctacccgttggtcctaccgttcgttcctcctccacgtcccttacccgaaccgtaaccggggtccctacgttcccggttaccctttccccccgg

SEQ ID NO: 389384 - DNA, 591 bp, Homo sapiens
  misc_feature: GZ8MTXP02GJ1ZP.44.23.C01.1.454.CMB.2.raw
  modified_base (361)..(361): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctgggctggatccggcacgccccgagggagggaatggagtggattggtgacatccattatacgtgggcgacgtactactctccgtcctacacgagtcgtctcacctatttcgnggacacgtccatcgaaccgtcttcctccctgaaactcgaacctccgtcgacccgccgcggaccacggtccgtttacttcgtggttcgcggtaggcgtacggtacgttcgggttctttacaaacgttcgtaagttcgggggccgtgggcctacccggtggtcctacgtcggtcctccgtctacgtccttacccgaccgtacgggccctacgtcccggttcctttcccccgg

SEQ ID NO: 389385 - DNA, 689 bp, Homo sapiens
  misc_feature: GZ8MTXP02FRD1A.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttgggctggactccggcacgccccgagggaggaagtggagtggagttggtgactatcctatagtcgtggggactacgtactacctcctccgtccctacaacgtacgtccgtctctacctagtttcgacggggacctacgtacctacgtaccgtaaccgtcttaccctaccctaagtaaaccctcgtaaccctccggtaccgacccgcccggtaccggaccgtaccgggttaccgtttactttccggtgtcggtacggacgggtacgtaacggttaccgttgggttacctttacgtaaacgtttaccgtacgggttacgggggtccgttcggacccgtacccgttcgggtacctacgttcgttcccttcccggtctactaacccgttacccaaccggtaaaccgggtccctacggttccccgttaccctttcccccggg

SEQ ID NO: 389386 - DNA, 576 bp, Homo sapiens
  misc_feature: GZ8MTXP02I8CYN.44.23.C01.1.454.CMB.2.raw
  modified_base (241)..(241): a, c, t, g, unknown or other
  modified_base (270)..(270): a, c, t, g, unknown or other
  modified_base (305)..(305): a, c, t, g, unknown or other
  modified_base (435)..(435): a, c, t, g, unknown or other
  modified_base (534)..(534): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngctgttgcctggttcaaacgaaaaggggnacggcccctaaggtcctcgtctctcgtagaaaccngactgggaaggtagacgtcccgtcgaggttcagtgccagtccagggtggtgggcccggagtccactctcaccatcgcactgccgcctagaagtacttctgactaactttatttcctgtacagctagttanctaagttacgtccgttaccccgtttcttaaccgttttcgggccgtaacgggggaaccaggcgtaggaaaactcgaaaacgactggtacggctgctaacncttcgtcgtcttcaagttccctcccgctatctacgtatttaa

SEQ ID NO: 389387 - DNA, 576 bp, Homo sapiens
  misc_feature: GZ8MTXP02H3KX9.44.23.C01.1.454.CMB.2.raw
  modified_base (350)..(350): a, c, t, g, unknown or other
  modified_base (531)..(531): a, c, t, g, unknown or other
  modified_base (546)..(546): a, c, t, g, unknown or other
  modified_base (557)..(557): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctgagtttccatcagttctgatcattcgttggggctggatccggcacgccccgagggagggaatggagtggatggtgacagtccattagtacgtggggacgtacgtactacctctcccgtccctcaagacgtcgtctcacctatttcgaggcacgtcatnaaccccgctctcctgaactcgacctccgtgaccgccgcgacacggtctttatctgtgcgaggcgagacgttggtctttacaattcgtagtcggggtccgttggcctacccgtggtccacgttcgtcctccttcgacgtccttacccgaccgaacggccctacgtccggtcccttcccccgngcccgccctgacccnccgacggaccnccgaccgtcggacggcacg

SEQ ID NO: 389388 - DNA, 724 bp, Homo sapiens
  misc_feature: GZ8MTXP02FMRPU.44.23.C01.1.454.CMB.2.raw
tcagacagtatatacacgaccggtgctcgatttagtacacgtgattagggattgggggctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcttggggctggactccggcacgcccccgagggagggagtggagtggattggtgacatccattatacgtggggcgacgtactactcctccgtccctcaacgcgtcgtctccacctatttcggacggggaccaccggtaccacgtcgtaacccgtcctttcctacccgtagaaaacctcgtaaccccttcccggtacggtaccccggcccggaccgggtaacccgtacccgggttcccgttttaactttccggttacggttcggaccgggtagggtaccggtaacgggtaccgtttcggggtttcccttttacgaaactttccgttaacgggttacggggggtcccggttcgggacccgtaccccggttggttacccgtaaccggttcggttcccttacccgtccgtaaccgtcccgtttaccccaaacccggtaaccgggtccccgtaacgttcccgggttccccctttccccccgg

SEQ ID NO: 389389 - DNA, 612 bp, Homo sapiens
  misc_feature: GZ8MTXP02F20W5.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgcccccgagggagggaatgggagtggagttggtgacatcctattagtacgtggggacacgtactactcctccgtcctcaagagtcgtctcacctatttcggaggtaccacgtccagtcgaaccccgtcttcctcctacgaaactcgaaccctccggtacgacccggtccgaccggaccgtaacgggttccgtttatttccgtggtcgcggacggcgagtacgtcggttctttacgattacgtaggtcggggccgtcggcctaccgtggtacctactcgtctcctcacgtccttccacgacggccctacgtccgtcctccccgtcgccgtccctcgcctccgacgtaccgccgtaccgtcggacggggcaccgg

SEQ ID NO: 389390 - DNA, 609 bp, Homo sapiens
  misc_feature: GZ8MTXP02HDVM8.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatctattcgttggggctggatccggcacgcccccgagggagggaagtgggaggtggagttgggtgacagtcattatacgtgggcgacgtactactctccgtcctcaagcgtcgtctacacctattcgaggacacgtccatcgaaccccgtcttcctcctacgaactcgacctccgtcgacccgccgcgaccacggtccgttttatctggtcgcgaggtcgaagtacgtcggtctttacgaatcgtagtcggggccttagggcctacccgtgggtcctacgtcgtcctcctcgacgtccttaccaacgtacgggccctacgttccggtcccttccccggcgcccgtccctggccctaaccgacggaccgtccgtacccgtcggtcgggggacctaaccgg

SEQ ID NO: 389391 - DNA, 619 bp, Homo sapiens
  misc_feature: GZ8MTXP02J4VS3.44.23.C01.1.454.CMB.2.raw
  modified_base (288)..(288): a, c, t, g, unknown or other
  modified_base (301)..(301): a, c, t, g, unknown or other
  modified_base (308)..(308): a, c, t, g, unknown or other
tcagacagtatatacacgaccggtgctcgatttagtacacgtgattagggattgggggctttctgagagtcaaggacctcctgtgcaagaacatgaagcacctgttggttttacctcctgctggtggcagctcccagatgggtcctgtcccaggtgcagctgcaggagtccgggcccaggactggtgaggcccttcggaaccctgtctctcatctgcactgtctctggtagtttccatcagttctgatcattctgggctggatccggcagcccccgaggaggagtggngtgagtgtgtacntaccatntaagtcgtacgggacgtaccgttccacttcctcccgtcctacccgacgtacgtcgtactcaccgttctcggtaacgacgtccgacgtctcgaccgtcgtaccctccgttacctacctcgaacccgtcccgtacggtaccccgtcggacccggacccggaccggtacgtttaccgtacgttttcgtgtcggtcgacgggtcgtacggcgttagtctacggtacttacgtacgtacgtcggtcggtcctggtcccgtcgtcctaccctggtccaaccgtctaccgtcctaccggcctacgttccccgtacccg

SEQ ID NO: 389392 - DNA, 647 bp, Homo sapiens
  misc_feature: GZ8MTXP02HZBE5.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctatttcgtgggctggatccggcacgccccgagggagggagtgggagtggagttggtgacatccattagtacgtggggacgtacgtactacctcctccgtcctcaagtacgtccgtctcacctattacggacggacacgtaccatcgaaccccgtcttcctacctacgtaactcgtaccctccgtcgacccgccgccgaccgtacggtcgtttacttcgtgtgcgtaggcgagtcgtcggttctttacaattcgtagtcggggtcgtcggcctaccgtcggtctacgttcgtcctcctcgacgtccttaccgaaccggtacgggtcccctacgttcccgggttcccttcccccggtcggccccgtccccgtcgtacccgttcccgaacggaccgtcccgtacccgtccggggtacgggggtacccacccgggg

SEQ ID NO: 389393 - DNA, 658 bp, Homo sapiens
  misc_feature: GZ8MTXP02I6NDB.44.23.C01.1.454.CMB.2.raw
  modified_base (311)..(311): a, c, t, g, unknown or other
  modified_base (602)..(602): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgccccgagggagggatggagtggtagttggtgacatccattatacgtgggacacgtactactctccgtcctnagacgtcgtctcacctattcgaggtacacgtccagtacgaaccccgtcttcctccctagtaactcgtaaccctccgtacgacccgccgtaccggacccgtacgggtccttttattccgtgttacggcgaaggccgtagtacttcgggttactttaccgaattcgtagtcggggccgttggccctaaccgtggtctaaccgtcgttcctacccgtctacgtcccttaccaaccgaacgggtcccctaaggttcccggtacccctttcccccggaggtcccccgtcccggtcncccgtaaccggacggtaacgtcccgtacccggtcggtaccgggggactaacccggg

SEQ ID NO: 389394 - DNA, 601 bp, Homo sapiens
  misc_feature: GZ8MTXP02G7L81.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaagtggagtggatggtgacatcatatacgtgggacgacgtactactcctccgtcctacaagagtcgtctcactattcgaggacacgtcatcgaaccccgtcttctcctagaactcgacctccgtcgaccgccgacgacctacggtccgttttattcgtcgtcggacgacggcgtaagtacgttggttcctttacaaattcgtaaggtcggggtccgtcggcctacccgtgtccgactcgtctacctcacgtccttaccgaccgtaacggccctacgttccggtccctccccggtcgcccgtcccgtcgccgtaacgacgacgtccaccggtcggtacggggaccaccgg

SEQ ID NO: 389395 - DNA, 773 bp, Homo sapiens
  misc_feature: GZ8MTXP02JN1GR.44.23.C01.1.454.CMB.2.raw
  modified_base (677)..(677): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttgggcgtggactccggcgacggcccccgaggggacggggaagtgggaggtggtagttggtgaacatacctaattagtacgtggggtcgacgtactactcctcccgtcctacaacgacgtcgtctcactacgttcgagggtacctacgtacctagtacgtaacccgtccttccctacccgtacgtaaacctaccgtacccgtccggttacccgaccccggtccccggacccgggtaaccgtaccgggttacccgtttttaacgtttccgttcggtcggtaccgggacgggtacggtaacggtaaccgttcgggtttacctttaacgtaaacgttcgttaacggggtccgggggtcccggtccgggtacccgtaaccccggtttgggtaaccccgttcgtttccgggttacccttccccggttntaacccgtcccggttttacccccaaaaccgggtaaaaccccggggttccccctaaccgggtttacccccgggtttacccccgtttcccccccgggg

SEQ ID NO: 389396 - DNA, 415 bp, Homo sapiens
  misc_feature: GZ8MTXP02H8PQ0.44.23.C01.1.454.CMB.2.raw
  modified_base (375)..(375): a, c, t, g, unknown or other
  modified_base (403)..(403): a, c, t, g, unknown or other
  modified_base (409)..(415): a, c, t, g, unknown or other
tcagacagtatatacacgaccggtgctcgatttagtacacgtgattagggattgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtgggccagggaccctggtcaccgtctcctcagcctccaccaaggcccatcggtccttccccctggccgcccctgcctccgaggacgccacctccgagacgcacagccggccctggggcctgcccctggtcaacggctacttcctatntacctgtcctgacgcgggctggcaggcncatagnnnnnnn

SEQ ID NO: 389397 - DNA, 582 bp, Homo sapiens
  misc_feature: GZ8MTXP02G0X8H.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggaggggaatgggagtggattggtgacatccattatacgtgggcgtacgtactactctccgtccctcaagagtcgtctcacctatttcgaggacacgtccatcgaaccccgtcttcctaccctagaaactcgacctccgtcgaccgccgcgaccacggtcctttattctgtgcgaggcgagtactggtcttacaatcgtagtcggggctggcctaccgtggtcacgttcgtcctcctcacgtccttaccaaccgaacggcccctacgtcccggttcccttcccccgcggccctccccgtgaccctcgaacggcgcctaccgtcggcggggacaccgg

SEQ ID NO: 389398 - DNA, 645 bp, Homo sapiens
  misc_feature: GZ8MTXP02FZSBJ.44.23.C01.1.454.CMB.2.raw
  modified_base (280)..(280): a, c, t, g, unknown or other
  modified_base (354)..(354): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgccccgagggagggatggagtggattggtgacatccattanacgtgggcgacgtactactctccgtcctcagacgtcgtctcactatttcgacgggacacgtcatacgaaccccncttcctcctagaaactcgacctcgtcgaccgccgacgacacggtccgtttattctgtgcgaggcgagtacgtggttcttacaatcgtagtcggggacctggcctacccgtggtcctacgttcgtccttccgtcgtacgtccttacccgaaccgaaccggggtccctaaccggttccggttcccccgtttcccccggttccggggtcccgtccccccgttcggtccccgttaacccggaacggggtaccgtaccccgtacccggttccggtcggggggaccctaacccgggg

SEQ ID NO: 389399 - DNA, 627 bp, Homo sapiens
  misc_feature: GZ8MTXP02I2EQK.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggactccggcacgcccccgagggagggatggagtggattggtgacatccattatacgtggggacgacgtacctacctctcccgtcctacgaagcgtcgtctcacctagtttccgaggaccaccgtccaatcgaacccgtccttcctccctagaaacctcgaccctccggtcgacccgccgacgaccgacggttccgtttattcgtgttcgcgtaggcgagtacgtcgttctttctaagtcgttacgtgggtccggtcgaccgtaccgtcggtctacctcgttcctcctcgtacgcttacccaccgacggtaccctacgttccggttcccgttccccgttcggcccgtcccgtcgcccgtaaccgacggtaccaccgaccgtccgtcgggggaccaaccgg

SEQ ID NO: 389400 - DNA, 640 bp, Homo sapiens
  misc_feature: GZ8MTXP02HQ6DP.44.23.C01.1.454.CMB.2.raw
  modified_base (165)..(165): a, c, t, g, unknown or other
  modified_base (225)..(225): a, c, t, g, unknown or other
  modified_base (247)..(247): a, c, t, g, unknown or other
  modified_base (282)..(282): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccngtctccttccttcctgtcttcttctgttggaggcagcgtcaccatccacgttggccgggngagtcgagggttcgttttcggngcttgttcgccgttggttacaaacggaaaaggggngacggtacccctaaggtcctcggtctctacgtagaaaccagacgtaggaaggtacgacgtcccgtcaggttcagtcgcagtccgagggtggcgggccccggagtccactctcacctattcgcgactggccgtctaggaaagtcttcgtacgacttaaactttattcgtgttacgagtactacgtatacgtagttacgtccgttccccgtttacttaccgttttcggaccggtacggggactaaggacgtaggaaactacgaaacgtacgtgtacggtactcgacctaaccgtacttaccttcgttaccttacgtaaccgtttcccttccccgtcctaattccgttattaactttaacg

SEQ ID NO: 389401 - DNA, 582 bp, Homo sapiens
  misc_feature: GZ8MTXP02I42KD.44.23.C01.1.454.CMB.2.raw
  modified_base (302)..(302): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgtgggctggatccggcacgccccgagggagggaagtggagtggattggngactatcctattatacgtgggacgacgtactactctcccgtcctacaacgtacgtccgtctcacctagttcgacgggacaccgtccatcgaaccgtcttctaccctagaaacctcgacctcgtcgaccgccgacggactaccggtcgtttactttcgtgtcgcgagcgagtactggttcttagaacttcgtagtcggggccgtggtacctccggtggtcctacgttgtccctcctcacgtccttacaccgacggccctacgttccggtccctttccccgg

SEQ ID NO: 389402 - DNA, 751 bp, Homo sapiens
  misc_feature: GZ8MTXP02H9YCS.44.23.C01.1.454.CMB.2.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcggggaaccctgtctctcatctgcactgtctctggtacgtttccatctagtttctgtacttctattcgttggggctggactccggcgacgcccccgaggggacggggaagtggaggtaggagttggagactatcctaagttactacggtggggacacgtacctactccttccgtcccctacgaacgtacgtccgtctcctaactcgtttaccggagggtaccaccggtacctagtacggtaaacccgtccttcgtaccccttagaaaaccttccggaacccgttcccggtacggaaccccgtcccgggaccgggtaccgtaccggggtttacccgtttttacgttttaccggtacgggttcggcccgggttaacgggccggtaaacggtaacccgtttgggtttacccttttacgtaaacgttccggtaaacgggttccgggggtacccgttcgggtaccctaaccccggttgggtaccctacgttcggttcccttccgtaaccgtccgtacccttaccgaacccgtaaccggggtacccttacggtttcccccgg

SEQ ID NO: 389403 - DNA, 616 bp, Homo sapiens
  misc_feature: GZ8MTXP02GI6C1.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattagtacgtggggcgacgtactactctccgtcctcaacgagtcgtctcactatttcgagggacacggtccatcgaaccgtcttcctccctagaaactcgacctccgtcgaccgccgcgaccgtacggtccgtttatttctgtacgcggtaggcgacggtctacggttctttacaagttcgttaggtcgggggtccgtcgggtacctacccgttgggtacctcgttcggttccctccttccgaacgtccctttcccgaaccgtaaaccggggtcccctacgttcccggtttccccgtttccccccgg

SEQ ID NO: 389404 - DNA, 917 bp, Homo sapiens
  misc_feature: GZ8MTXP02HLUB2.44.23.C01.1.454.CMB.2.raw
tcagacagtatatacacgaccggtgctcgatttagtacacgtgattagggattgggggctttctgagagtcaaggacctcctgtgcaagaacatgaagcacctgtggttttttcctcctgctggtggcagctccagatgggtcctgtcccaggtgcagctgcaggagtcgggccaggactggtgaggccttcgggaacctgtctctcatctgcactgtctctggagtttccatcagttctgatcattcgttggggctggatccggcacggcccccgaggggacggggaagtgggaggtggtaagtttgggtaggtacagtaccctaatttaacgtacggtcggggacgtaacggttaccttaaccgttccgttaccccgtaccccttacgaaaccggtaacgttccgtccgttaccaacccgttacgttttaccgggacggggtaaccgtaaccgttacccgtaaacgttaccggtaaaaccccggtcccttttaccccgttaacccccgtttaacggtaaaaaacccgttccggtaaacccccgttaccccggtaccggggttaaaacccccgggtccccgggaaccccggggtaaacccgtaaccccgggggtttaccccgttttttaaacgttttacccgttcgggttaccgggtacccgggtaaggggtacccggtaacgggttaaaccggtttcggggtttacccttttaaccgtaaacgtttacggttaacggttacggggggtccccggttcgggtaccccgtaaaccccgtttcggggtaaacccttaccgttccgggtttacccttccccgttacgtacccggttaaccccgtttaccccgaaacccggtaaaaccgggggcccccttaaccggtttccccgggtttacccctttccccccccggggg

SEQ ID NO: 389405 - DNA, 678 bp, Homo sapiens
  misc_feature: GZ8MTXP02HJ7SK.44.23.C01.1.454.CMB.2.raw
  modified_base (304)..(304): a, c, t, g, unknown or other
  modified_base (322)..(322): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctcgtggatttccatctagttctgatcattcgtgggctggatccggcacgccccgagggacgggaagtcggagtggagttggngacagtccattagtacgnggggacgtacgtacttactctcccgtcctacaacgtacgtcgttacactaccgtagtttcggagggtacctacgtaccagtacgtaccgtacgttcctacccgtagaaaccgtcgtaccgtacccgtgacccgccgtcggacctaccgggttcgttactttacgtcgttggcggtacgggtcgaacgttacgttcgggttacctttaacgactttacgttaacggtcgggggtcccgttcggggtaccctacccgggtttgggacccttacggttaccggttccttaacccgtcgtaaccggtcccttaccgaacccggtaacgggccctacgttccggttcccctttacccccgg

SEQ ID NO: 389406 - DNA, 671 bp, Homo sapiens
  misc_feature: GZ8MTXP02HC0BD.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtatctattcgttggggctggatccggcacggccccgagggagggagtggaggtggagttggtgacatccattatacgtgggacgtacgtactactcctccgtcctcaacgtcgtcgtctcactacttcgacgggtaccaccgtaccagtcgaaccgtccttcctaccctagaaacctcgacccgtcgtccgaccgcccgcggtaccgaccgggttccgtttactttcgtacggttcggcgggtacgggaccgtaggtaccgttcgggttacctttacgtaaacgttcgttaagggtcgggggtacccgtcgggtccctacccggtgggttacccacgttccggttaccctcctaccgtaccttaacccgtacccgaaccggtacccgtacccgttccggttaccccggttcccccgtttccccggg

SEQ ID NO: 389407 - DNA, 671 bp, Homo sapiens
  misc_feature: GZ8MTXP02JWF7S.44.23.C01.1.454.CMB.2.raw
  modified_base (644)..(644): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttgggctggactccggcacggccccgagggagggaagtgggagtggtagttggtgacatcctattatacgtgggcgacgtactactcctcccgtcctacaagacgtccgtctccacctagttcgacggacacgtccatcgaaccccgtcttcctcctacgaactcgtacctccggtacgacccgccgaccgtaccgtaccggttaccgtttattcgtagtcgcggaggcgtaagtcgttcggttctttacgaattcgttagggtccgggggtaccgttcggacccgtacccgttcgggtacctacgtcgttcctcccgtcgtacgttacccttacccgaacccggtaacggcccctacggttccccgggttaccccgttcccccgttcggcccccgtccgtccgtccgtaacccggacggccnccgtccgtcgggtcggggaccaccggg

SEQ ID NO: 389408 - DNA, 652 bp, Homo sapiens
  misc_feature: GZ8MTXP02JELXG.44.23.C01.1.454.CMB.2.raw
  modified_base (208)..(208): a, c, t, g, unknown or other
  modified_base (222)..(222): a, c, t, g, unknown or other
  modified_base (244)..(244): a, c, t, g, unknown or other
  modified_base (282)..(282): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttctgttcttcttctgttggaggcagctcacntcacttggccgggnagtcgtaggttcggttttcggngtcttgttcgccgttggtttacaaacggaaaagggggngacggtaccccgtaaggtcctcgtctctacggtacgaaaccagactagggaaggtacggacggtccccgtcgtaggttcgacgttcgcctacggtccgaggggtgggtcggggccccggtacgtcccactccgcaaccgtagttcgccgtaccgtggaccggtcctaggaaacgtctttacgtgtaccttaacgtttactttctgtacaggtctaagtactactagttacgttccgtaccccgtttgtaccgtttcgggaccggtaacggggacctaacggtcgtaaggtaaactacgaaacgtacgtggtacgctacgaccgactactcgtcttctctaacttcctacccgctactactagtacttacg

SEQ ID NO: 389409 - DNA, 690 bp, Homo sapiens
  misc_feature: GZ8MTXP02J3SA2.44.23.C01.1.454.CMB.2.raw
  modified_base (190)..(190): a, c, t, g, unknown or other
  modified_base (226)..(226): a, c, t, g, unknown or other
  modified_base (249)..(249): a, c, t, g, unknown or other
  modified_base (287)..(287): a, c, t, g, unknown or other
tcagacagtatatacacgaccggtgctcgatttagtacacgtgattagggattgggggagtcagaccctgtcaggggacagcatggacatgagggtccccgctcagctactggggctcctgctgctctggctcccaggttcgagatgtgacatcgagatgacccagtcctccttccttcctgtcttcttntgttggagcagccgtcaccatcacgttcggccgggngagtcgtagggttccgttttggngtcttgttcgtccttaggttacaaacggtaaaaggggnacggtaccccgtaagtcctcgtctcgtacgtacgaaacctagaccgtagggaacggtacgaccgtcccgtacgaggttcacgtcgaccacggtccgaggggtcgggtacggccccggacgtacccactctacgacctagttaccgccgtaccgtggccgtctacggtaaagtcttcgtacgtaaccttaactttactttcgcgttaccgagtcgtagtactactagttaccgttccgtccccgttacttaccgtttcggacccggaagggaccctaggacgtaacggtaaaactacgtaaaacgtacgtcgtacgggtacctacgacccgtaacctacttccggctttacccgtaaccttccgttacccgtttccccgacttacgttccgtactaatttaacc

SEQ ID NO: 389410 - DNA, 559 bp, Homo sapiens
  misc_feature: GZ8MTXP02G4U6E.44.23.C01.1.454.CMB.2.raw
  modified_base (241)..(241): a, c, t, g, unknown or other
  modified_base (271)..(271): a, c, t, g, unknown or other
  modified_base (306)..(306): a, c, t, g, unknown or other
  modified_base (376)..(376): a, c, t, g, unknown or other
  modified_base (397)..(397): a, c, t, g, unknown or other
  modified_base (401)..(401): a, c, t, g, unknown or other
  modified_base (440)..(440): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccggcgagtcaggttcgttttcggnctgttgccttggttacaaacgaaaaggggnacggcccctaaggtcctcgtctctcgtagaaaccngactggaaggtagacgtcccgtcaggttcagtgccagtccagggtggtgggcccgagtccactctcaccntacgcacctgccgctgaagtnttcngctaacttattctgtcagcagtatcatagtcgtcccttntacgtttcggaccgtaaggggaccaagtcgtaggaaactcgaaaacgtagtggtacggctacgacctaacacttccgtcgtccttacaacgttccttcccgactatcctacgatttaac

SEQ ID NO: 389411 - DNA, 569 bp, Homo sapiens
  misc_feature: GZ8MTXP02JT2GF.44.23.C01.1.454.CMB.2.raw
  modified_base (535)..(535): a, c, t, g, unknown or other
  modified_base (554)..(554): a, c, t, g, unknown or other
  modified_base (567)..(567): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccagggacgggaatgggagtggattggtgacatccattatacgtggggcacgtactactctccgtcctcagagtcgtctcacctatttcgaggacacgtccatcgaaccccgtcttctcctagaactcgacctccgtcgaccgccgcgacacggtcgtttattctgtacgcgtaggcgagacttggtctttacgaacttcgttaagtcgggggtccgttggccgtacccgtgggtacctcgtcgtcctacctcaacgtcttacccacgaacggtcccacgtccggtcccttcccgngccgccctgacctcgagcncactcgcgggacncg

SEQ ID NO: 389412 - DNA, 594 bp, Homo sapiens
  misc_feature: GZ8MTXP02JY7UU.44.23.C01.1.454.CMB.2.raw
  modified_base (311)..(311): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccgagggagggaatggagtggattggtgacgatccattanacgtgggcgacgtactactctccgtccctcaagagtcgtctcacctatttcgagggacacgtccatcgaaccgcttcctccctagaaacctcgacctccgtgacccgccgcgacacggtccgtttattctgtgcgtaggcgagtactggtctttacgaatcttagtcggggtccgtcggtcctacccgttgggtaccacgttcggttcctcctcgtaacggtccctttacccgaccggtaaacggggcccctaacgttcccggggttccctttcccccccggg

SEQ ID NO: 389413 - DNA, 586 bp, Homo sapiens
  misc_feature: GZ8MTXP02FPVFP.44.23.C01.1.454.CMB.2.raw
  modified_base (360)..(360): a, c, t, g, unknown or other
  modified_base (545)..(545): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggaggggaatggagtggattggtgacagtccattacgtactggggcgacgtactactctccgtcctcaagacgtcgtctcaccatttcgaggacacgtcatcgaaccccgcttcncctgaactgacctccgcgaccgccgcgaccacggtccgtttatttcgtgtcgcgaggcgagacgtggttctttacaatcgtagtcggggccgtcggctaccgtgggtccacgtcgtcctcgtctacgccttaccaaccgtaacggcccacgtccgttcccgttcccccgtcggcccgtcccgtcnccgttccgaacggcgaccgacccgttcggcggggcacccgg

SEQ ID NO: 389414 - DNA, 682 bp, Homo sapiens
  misc_feature: GZ8MTXP02JZ88S.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggccaggactggtgaggccttcgggaaccctgtctctcatctgcactgtctcgtggtagtttccatcagttctgatcatttcgttggggctggacgtccggcacgccccgagggagggaagtggagtggagttggtgacatacctattacgtacggtgggacgtacgtactactccgtcccgtcctacgaagacgtccgtctacgacctagtttcggaggacacgtaccagtcgaacccgtcttcctacctagaactcgtacctccgtcgacccggccgacggaccgtaccggttaccgttttagtttccgtcggtcggacggtacgggtacgtaggtacgttcggttactttacgtaaacgttcgttaacggggtcgggggtcccggtacggccctaccggttcggtccgtacgttcgtccttcctcgtactccgttaccgaaccgaaccggtccctacgttcccggttccctttcccccggcggtcccgtcccgtcgtccgtaaccgacggcgtcccgtaccggtccggacggggccacggg

SEQ ID NO: 389415 - DNA, 586 bp, Homo sapiens
  misc_feature: GZ8MTXP02H6P06.44.23.C01.1.454.CMB.2.raw
  modified_base (473)..(473): a, c, t, g, unknown or other
  modified_base (548)..(548): a, c, t, g, unknown or other
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatctagttctgatctattcgttgggctggatccggcacgcccccgaggggacggggaatgggaggtggagttggtgacatccattagtacgtggggcgacgtactactctccgtccctcaacgacgtcgtctcacctatttcggacggggtacacgtccatacgaaccgtcttcctccctagaaacctcgacctccgtgacccgccgcggacctacggtccgtttattcgtggtgacggnggcgtacgtcgttggttctttacaaattcgtagtcggggtccgtcgtccgacccgttggtacctgtcgtctcctncgtcctcgaccgacggtcccagttccgtcttcccccgg

SEQ ID NO: 389416 - DNA, 638 bp, Homo sapiens
  misc_feature: GZ8MTXP02GXH2O.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggactccggcacgccccgagggagggaagtggagtggattggtgacatccattatacgtgggacgacgtactactctcccgtcctacagcgtcgtctcactatttcggaggaccacgtccagtacgaaccccgtcttcctccctagaaacctcgtaccctccgtacgacccggccgaccggacctaccgggttccgttttactttcgtggtcgcggtagggcgagtcgtcggttctttacaagttctaggtcggggtcgtcggcctaccgtggtctacgtcgtcctcctcgacgtccttaccgaccgtaaccggccctacgttcccggttacccgttccccgtcggtcccgtccccgtcgtcccgtaaccgacggacgtacccgtaccgtccgggtcgggggaccacccggg

SEQ ID NO: 389417 - DNA, 754 bp, Homo sapiens
  misc_feature: GZ8MTXP02I0Z98.44.23.C01.1.454.CMB.2.raw
  modified_base (222)..(222): a, c, t, g, unknown or other
  modified_base (241)..(241): a, c, t, g, unknown or other
  modified_base (270)..(270): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttggccgggngagtcaggttcgtttcggngctgttgcctggttacaacgaaaaggggnacggaccccgtaaggtcctcgtctctcgtagaaaccagactggaagtagacgtcccgtcaggttcacgtgaccagtccgagggtggtcgggcccggacgtccacgtccgtcaaccctatttcggacccgtaccgtcgggcccggtaccctaggtaaacgtctttaccgtacgtacccttaaaacgttttgttttccttacgggttacctaacggtaccttaaaggtttactacccgtaagttaaaccggttcccggtcccccgtttttacgtacgtttttacccggggacccggaaacgggggtaaccctaaaggtacccggttaagggaaaaaccttaccggaaaaacgtaaccgttgggttaacgggccttacggacccgtaaaaccgtactttacccgttcggtttacccttaccgttaaaccgttccccctttacccccggtaacgttaaccttccggtagttaaaactttttaaacccg

SEQ ID NO: 389418 - DNA, 560 bp, Homo sapiens
  misc_feature: GZ8MTXP02F2J3I.44.23.C01.1.454.CMB.2.raw
  modified_base (462)..(462): a, c, t, g, unknown or other
tcagacagtatatacacgaccggtgctcgatttagtacacgtgattagggattgggggctttctgagagtcaaggacctcctgtgcaagaacatgaagcacctgtggtgtttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacggcccccaggggacggggaatggaggtggattgggtgacagtccattagtacgtggggcgacggtactactctccgtcctacagtagtcgtctcacctatttcgaggacacgtccagtcgaaaccgcttcctaccctagaaacctcgaccctccgtcgacccgccggcgaccacggtctttattctgtcgcgngcgagacgtggtcttcaatcgtagcggggctggccaccgtgtacacgtcgtcctcctcgaacgtccttaccaccgacggtccctagtccggtttcccc

SEQ ID NO: 389419 - DNA, 631 bp, Homo sapiens
  misc_feature: GZ8MTXP02F60PO.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgccccaggtgcagctgcaggagtcgggcccaggactggtgaggccttcgggaaccctgtctctcatctgcactgtctctggagtttccatcagttctgatcattcgttgggctggatccggcacgccccgagggagggatggagtggattggtgacatccattagtacgtggggcgacgtactactctcccgtcctcaagagtcgtctcacctagtttcgacgggacacgtccagtcgaaccccgtcttcctcctacgaactcgaccctccgtcgacccgccgaccgaccgtaccggtaccgtttactttcgtgtcgcggtaacggcgtagtacgtcggttacttacgtaatcgttagtcggggtccgtcggcccgtaccgtggtacctacgtcgttcctcctctacgtccttaccaccgaacggccctacgttccggttcccgttcccccgtcggtcccgtccccgtcgtacccgtccgacggaccgaccgtcccgtcggtcgggggaccacccggg

SEQ ID NO: 389420 - DNA, 833 bp, Homo sapiens
  misc_feature: GZ8MTXP02I4ZWX.44.23.C01.1.454.CMB.2.raw
  modified_base (223)..(223): a, c, t, g, unknown or other
  modified_base (284)..(284): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtcctccttccttctgttcttcttctgttggagcagcgtcacatcacgttcggccgggnagtcgaggtttcggtttcggtgcttgttcgccgttaggtttacgaaaacggaaaagggggngaccggtaccccgtaaggttccctacggtctccgtacggtacgaaaccgaggtacgtagggaaaggtacggacgtccccgtcgtaaggttcgagtcgacctaggtaccggagggttcggggtcggggaccccggtacgtacccgtacttccgtaccaaccgttacgttacggccgtaaccgtgggcccgtacgtaggtaaaacgtcttcgtacgtaccttaaacgtttttatttccgtgttaccgtacgtacgtaacgttaacgtaccgttacgttaaccggttccccggtttacccccggtttacgtttaacccgggtttttaccgggggacccgggtaaaacgggggttacccctaaagggttaaccggttaacgggtaaaaaaccgttaccgaaaaaaccgggttcgttacggggttaaccggtcgtaaaccgtaccgtaaaccccttcgttaccggtttacgtttccccttaaccggttaaccgtttacccccgttacccggtacccttaaccggtttaccgttaagtttaaacgttttaaaccg

SEQ ID NO: 389421 - DNA, 564 bp, Homo sapiens
  misc_feature: GZ8MTXP02JPOT5.44.23.C01.1.454.CMB.2.raw
  modified_base (370)..(370): a, c, t, g, unknown or other
  modified_base (396)..(396): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgaggggacggggaatgggagtggattggtgacatccattagtacgtggggcgacgtactactctccgtccctcaacgagtcgtctcacctattcgngggacacgtccatcgaaccgtcttcnccctgaaactcgacctcgtgaccgccgcgacacgcctttattctgtgcgagcgagactggtctttcaattctagtcggggaccgtggcctacccgtggtccacgttcggtcctccctcacgtccttacccgaccgacgggccctacgttcccggtcctttacccccgg

SEQ ID NO: 389422 - DNA, 666 bp, Homo sapiens
  misc_feature: GZ8MTXP02IJE4A.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtcctctcatctgcactgtctctggtagtttccatcagttctgatcattcgttgggctggatccggcacgccccgagggagggagtggagtggtagttggtgacgatctattagtacgtgggacgacgtactacctcctcccgtcctacgacgtacgtccgtctactacctagtttacggaggaccacgtccatacgaccccgtcttcctacccgtagtaactccgaaccctccggtaccgacccggcccggaccggtaccgtaccgggttcgttttactttcgtggtcgtacggaggcgtagtacgttcggttactttacaaagttcgtaggtcgggggtccctaggccctaccgtggtactacgtcgtccttctctacggtccttaccgaccgtaacgggccctacgttcccggtcccttccccgcgggtccctccccgttgcccgttaaccggaacgggcctaccctaccggttccgggcggggaacccgcgg

SEQ ID NO: 389423 - DNA, 691 bp, Homo sapiens
  misc_feature: GZ8MTXP02J4SYY.44.23.C01.1.454.CMB.2.raw
  modified_base (318)..(318): a, c, t, g, unknown or other
  modified_base (434)..(434): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctgagtttccatcagttctgatcattcgttggggctggactccggaccacgcccccgaaggggaggggaattggaagttggatggtgacatccattatacgtgggcacgtactactctcccgtccctnagtacgtcgtctacaccatttcggaggggtaccacgttccatgaacccccgcttcctccctagaaactcgacctccggtacgacccgccggccgtaacgtcgtccgttttattcgngttggcgaacgggcgaagtacgttggttctttacaagttacgttaagcgggggtaccgtccggggtcacccccgtttgggccctacttcggtcctttcccactaacccggtcctttaccccgaacccgaaaacggggtcccccagttccccggtccttttccccccggtcggtccccggccccttcggaaaccctttaacccgtaccggaccggtaccgtacccgacccggtttaccgggtaccgggtaccccgggg

SEQ ID NO: 389424 - DNA, 590 bp, Homo sapiens
  misc_feature: GZ8MTXP02FMRPX.44.23.C01.1.454.CMB.2.raw
  modified_base (316)..(316): a, c, t, g, unknown or other
  modified_base (551)..(551): a, c, t, g, unknown or other
  modified_base (557)..(557): a, c, t, g, unknown or other
  modified_base (566)..(566): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggaggggaatggagtggagttggtgacagtccattactacgtggggcgacgtactactctccgtcctcaagngtcgtctcactattcgaggacacgtcagtcgaaccccgtcttcctcctagaaactcgacctccgacgaccgccgcgaccacggtcctttattcctagtcggcgtaggcgtagtacgtcggttctttacgaattcgtagtcgggggccctgggccctaccgtgtccatcgtctccgtctacgccttaccgaccgaaccggtcctacgtccggttccctccccgtcggccctcccgngtcccncgacggacncctaccgtcggcggggaccaccgg

SEQ ID NO: 389425 - DNA, 607 bp, Homo sapiens
  misc_feature: GZ8MTXP02H7VCF.44.23.C01.1.454.CMB.2.raw
  modified_base (218)..(218): a, c, t, g, unknown or other
  modified_base (234)..(234): a, c, t, g, unknown or other
  modified_base (264)..(264): a, c, t, g, unknown or other
  modified_base (294)..(294): a, c, t, g, unknown or other
  modified_base (399)..(399): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttccttcctgtcttctctgttggagcagcgtcaccatcacttgccggnagtcaggtcgtttcgngctgttcgcctggttacaacgaaaaggggnaggcccctaaaggtcctcgtctcgtcgtanaaacccgagactggaacgtagacgtccccgtcgtaggttcagtcgccagtccgaggtcggtggcccgagtcccatctcaccattagcacgtgcgtctgaaacgtntctagtactaacttattcgtgtacagtacagtactactagttacgtccgtcccgttactacgtttcgggaccggaacggggtacccaaggtactaacggaaacgtaccgaaaacgtacgtgtacggctaacgccgtaacctacgttacgttacgttaccgttactaaccgttacccgttacccgacctacgttactacggtaactaac

SEQ ID NO: 389426 - DNA, 654 bp, Homo sapiens
  misc_feature: GZ8MTXP02F2OFW.44.23.C01.1.454.CMB.2.raw
  modified_base (450)..(450): a, c, t, g, unknown or other
tcagacagtatatacacgaccggtgctcgatttagtacacgtgattagggattgggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggacgggaatggagtggattggtgacgatccattatacgtggggacgacgtactactctccgtcctacaagtagtcgtctcacctatttcgagggacacgtccatcgaaccccgtcttcctacctacgaactcgtacctccgtcgaccgcgaccgacacggtcctttattcgtgtcgcgacggcgtagaccgtggttacctttanaatccgtaggtgggggtcccgttaggaccctaccgttgggtaccctacgttccgtccctccttcgaaccgtccgtttaaccccaccggtaaaccgggccccttaaacgttcccgggtaccccttcccccgtacggggcccctccccgttgcccttcccgaacggtacgacccccgtaaccgttcggtccgggggacaacccggg

SEQ ID NO: 389427 - DNA, 576 bp, Homo sapiens
  misc_feature: GZ8MTXP02JP0LY.44.23.C01.1.454.CMB.2.raw
  modified_base (527)..(527): a, c, t, g, unknown or other
  modified_base (534)..(534): a, c, t, g, unknown or other
  modified_base (553)..(553): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcatttcgttggggctggactccggcgacgccccgagggagggaagtgggagtggagttggtgacatcaattagtacgtgggcgtacgtactactctccgtcctcaagcgtcgtctcactatttcgaggacacgtccagtcgaaccccgtcttcctcctagaactcgacctccgtcgaccgccgcgacacggtctttattctgtgcgaggcgagtacgtgttcttacaatcgtgtcggggctggacctccgtggtccacgtcgtctccctgacgtcctaccgacgacggccctagttcccggtccttccccggngaccccnccgtcgcctccgaggtccnccgtaccgtcggacgggcaacgg

SEQ ID NO: 389428 - DNA, 660 bp, Homo sapiens
  misc_feature: GZ8MTXP02FO06U.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttgggctggatccggcacgccccgagggagggaagtggaggtggagttggtgacatccattagtacgtgggacgacgtactactcctcccgtcctacaagtacgtcgtctcacctagtttacggacgggactaccgtccagtacgaacccccgtccttcctaccgtacgtaaacctcgtaacccgtccgtacggacccgtccggaccggaccgtaccgggtccgttttatttccgtagtcgacgtacggcgtagtacgtcggtttcttacgatcgtagtcggggtccgtggcctacccgtggtacctactcgtctcctcgtacgtcctaccgaacgacgggtaccctacggttccggttccccgttccccgtcggccccgtcccgtcgtcccgtaaccgacgggacctacccgaccgttcggccgggggaccaaccgg

SEQ ID NO: 389429 - DNA, 628 bp, Homo sapiens
  misc_feature: GZ8MTXP02F2K78.44.23.C01.1.454.CMB.2.raw
  modified_base (355)..(355): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatcagtttctgatctattcgttggggctggactccggcacggcccccgaggggaggggatggagtggagttggtgacatccattagtacgtggggacgacgtactactcctccgtcctnaacgagtccgtctccactatttcggagggacacggtccatcgaaccgtcttcctccctagaaacctcgacctccgtacgacccgccggacggaccgtacgggtaccgtttatttccgtggtcgccggaggtcgaacggtcgttacgggttctttacgtaacgttcgttacggtcgggggtccgtcggccgtacccggttggtcctaacgttcgtccttacctcgtacgtccttacccgaacgtaccgggcctacggtccgtccctttccccgg

SEQ ID NO: 389430 - DNA, 603 bp, Homo sapiens
  misc_feature: GZ8MTXP02HQFY1.44.23.C01.1.454.CMB.2.raw
  modified_base (435)..(435): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctatttcgtgggctggactccggcacgccccgagggagggaagtggagtggagttggtgacatacattacgtacgtgggacgacgtactacctcctccgtccctagagtcgtcgtctctacgtagtttcgaggtacacgtaccacgtacgaaccccgtcttacctcctacgtaactcgacctccgtcgccgccgccgacgacggtcctttattctgtcgngacggcgtagtacgttggttcttacaacgtcgtaggtcggggtaccgtcggtccgtaccgtcgtctacgtcgttcctcctcacgtcctaccgacgaccggcctacgttccggtccttcccgcgccgcccgtcgcctccgacggcgccgaccgtcggcggggacaccgg

SEQ ID NO: 389431 - DNA, 701 bp, Homo sapiens
  misc_feature: GZ8MTXP02GIU73.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccgttcgggaaccctgtctctcatctgcactgtctctggtagtttccatctagttctgatctattcgttgggctggacgtccggcacggccccggagggagggaagtgggaggtggtagttggtacgacgtactacctaattacgtacggtggggaccgtaacgtacctaccgttccgtcccgtacctacgaagtacgtccgtcctcctaacctacgtttacggacggtacctaccgtaccgacgtaccgaccccgtccttaccgtaccctaacgtaacctccgtacccgtccggtaccgacccgccgaccgaccgtaccggttccttttacgttcgtgtacggcgaggacgtagtcgttcggttcttacgaacttcgtacgggtccggggtccgtcgggccctaccggtcggtacctacgttcctcccgttcgtacgaccgtcccttacccgaaccggtaaccggtccctaccgttcccgttcccctcccgtcgcccgtccctcgaccgtccgacggcctccgacggtcggcggggaccacgg

SEQ ID NO: 389432 - DNA, 648 bp, Homo sapiens
  misc_feature: GZ8MTXP02FW5SF.44.23.C01.1.454.CMB.2.raw
  modified_base (364)..(364): a, c, t, g, unknown or other
  modified_base (410)..(410): a, c, t, g, unknown or other
  modified_base (447)..(447): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggaagtggagtggtattggtgactatcctattagtacgtgggcgacgtactacgtcctccgtcctgaagcgtcgtctcactagttcgacggtacacgtcatcgaacccgtcttcncctagaactcgacctcgcgaccgccgcgactacggtcgttatttcngtacgccgaggccgtagtacgtcggttaccttttaanaacgttcgtacggtcggggtcccgtcggtacccgtaccggttacggtaccgtaccgttccgttacccttaccgtacgtaccgtccttaacccgaccgtaaccggtccctacggttcccggttccccttaccccggtcggtccccgtcccgtaccgtccgtaaccgtacggtccgtacccgtacggtacggacggaccacgg

SEQ ID NO: 389433 - DNA, 696 bp, Homo sapiens
  misc_feature: GZ8MTXP02JKBIF.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgccccgagggagggaatggagtggagtggtgacatcctaattatcgtgggcgacgtactacctcctcccgtcctacagtcgtcgtctcacctagtttcgaggaccacgtccagtcgaaccccgtcttacctcctacgaaactcgaccttccgtacgacccggccgacgacgtaccggttcgtttacttcgtgtacgcggaggcgtagtacgttcggttactttacgtaacgttcgttaacggtcgggggccgttcgggccgtacccgttcggttaccgtaaccgttccgttcccgtccgttaccgaccggttacccttaaccccgaaacccgtaacccggggtaccccttaccggttcccggtttcccccgttcccccggtccgggtccccgtcccgttccgtacccgtccggacggtaaccgtcccgaccggttccggggtccggggacccaccggg

SEQ ID NO: 389434 - DNA, 611 bp, Homo sapiens
  misc_feature: GZ8MTXP02JOBMD.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacgcccccgaggggacggggaatgggagtggagttggtgacatccattactacgtgggcgacgtactactcctccgtcctacaacgtcgtaccgtctcacctagttcgagggaccacgtaccatcgaaccgtcttccaccctagaaacctcgacctccgtcgacccgccggacggacgtcggtaccgtttacgtttcgtgtcggcgacgggcgtacggtacttgggttctttacgattccgtaggttcggggtcgtcggtccgtacccgttggtcctacgttcgtccttctcgacgtcccttaccgaccgacgggccctacgtcccggtccttcccccgg

SEQ ID NO: 389435 - DNA, 577 bp, Homo sapiens
  misc_feature: GZ8MTXP02HUEEI.44.23.C01.1.454.CMB.2.raw
  modified_base (351)..(351): a, c, t, g, unknown or other
  modified_base (553)..(553): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggaggggaatgggagtggattggtgacatccattatacgtgggcgacgtactactctccgtcctcaagagtcgtctcacatttcgaggacacgtccatcgaacccncttcctcctgaactcgactccgtgacccgccgcgaccgcggtcgtttattctgtcgcgtaggcgagacgtgttcgtttcaaacttctacgtggggccgtggcgtacctcggtcactgtcctcctcgacgtccttccaccgtaacgggccccacgttcccggtccttcccccgttcggcccgcccgttcgccttccgacggcncgaccgtcggtcgggggccaccgg

SEQ ID NO: 389436 - DNA, 691 bp, Homo sapiens
  misc_feature: GZ8MTXP02JAMGO.44.23.C01.1.454.CMB.2.raw
  modified_base (247)..(247): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgttcttcttctgttggaggcagcgtcaccatcacttggccgggcgagtcgtaggttcgttttcggngtcttgttcgccgttggtttacaaacgtaaaagggggacgacggtaccccgtaaggtccctcgtctcgtcggtacgaaaccagacgtagggaaggtagacgtcccgtacgtaggttcagtgccagtccgagggtggtcggcccggatccacgtcctacacctagttcgccgacgtcgaccggtcctagaacgtacttcgtagtaccttaactttatttcgtgtactagtctaagtataccgtattacggtccgttaccccgtttacttcgttttaccgggaccgtaaacgggggacccaaggtacctaagggtaaaactccgaaaacgtacgtaggtaccgtacgtacgacctaaacctacgttccgttacgttacccttaccgtaaccgttttccccgttaacccccggtactaacgtttaccgttaacgttaatttaaaccg

SEQ ID NO: 389437 - DNA, 635 bp, Homo sapiens
  misc_feature: GZ8MTXP02IPCLF.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgccccgagggagggaagtgggaggtggattggtgacatcctatactacgtggggacgacgtactactcctcccgtcctcgaagcgtcgtctcacctatttcgaggacacgtccatacgaaccccgtcttcctccctagaaactcgaccctccgtcgacccgccgaccggaccgtaccggtaccgttttacttcgtagtcgtacggaggcggacgtacgttgttacttcgaattcgtaggtcggggccgtggcctaccgtcgtcacgtcgttctcctcacgtccttaccaaccgtaacggtcccctacgttcccggtcccttcccccgtcggtaccccgtcccgtacgccgttccgacgggtacacccgtaccgtcggtacggggacctacccggg

SEQ ID NO: 389438 - DNA, 567 bp, Homo sapiens
  misc_feature: GZ8MTXP02FK0AI.44.23.C01.1.454.CMB.2.raw
  modified_base (274)..(274): a, c, t, g, unknown or other
  modified_base (407)..(407): a, c, t, g, unknown or other
  modified_base (551)..(551): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctggtttacaacgaaaaagggggnaggcccctaaagggtcctcgtctctcgtagaaaccagactgggaaggtagacgtcccgtcaggttcagtgccagtccaggtggtgggccccgagtccactctcaccattcgcgactgccgcctagaagattcngactaacttagtttctgtcagctagtatacattagtccgtccccgttctacgttttcggaccgaggggtacccaaagcgtaggaaaacttcaaaaacgtactgtacggctggaccaccatctcgtctttcaacttccttacccncctattctatattaac

SEQ ID NO: 389439 - DNA, 535 bp, Homo sapiens
  misc_feature: GZ8MTXP02FXYIA.44.23.C01.1.454.CMB.2.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttggtgctgttgcctggtttacaacgaaaaagggggagaggcccctaagggtcctcgtctctcgtgaaaccagactggaaggtagagtcccgtcaggttcagtgccagtccaggtggtgggccccggagtccactctcaccattgcgactgcgctgaagattctgcaacttatttctgtcagcagtatcatagtcgtccccgttctacgttttcgggaccgaggggaccaagctaggaaactcaaaacgaactgtcgctgcacatctcgtcttcaactcttcccgcctactctcgatac

SEQ ID NO: 389440 - DNA, 701 bp, Homo sapiens
  misc_feature: GZ8MTXP02FORZG.44.23.C01.1.454.CMB.2.raw
  modified_base (375)..(375): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgtgggctggactccggcacgccccgagggagggatggagtggtattggtagacatcctattagtacgtgggcgtacgtactactccgtcccgtcctacagtacgtcgtctccacctagtttcggaggactacgtccacgtcgaaccccgtccttccncctagtaactcgacctccgtcgaccgccgccgaccgtacggtcctttactttcgtgtcgcgtacggcgtacgtacgtggtttcctttaacgacttcgtaggtcggggtccgtagcccgtaccgtcggtactaccgttcgtcccttccgtccgtacggtacccttaaccccgaaaccggtaacccgggtaccccttaccgggttccccggttaccccctttccccccgggttacgggtccccgtcccccgttcggttaccccgtaacccggtaaacgggcccgtacccgttaacccggttccgggaccgggggacctaaccccgggg

SEQ ID NO: 389441 - DNA, 659 bp, Homo sapiens
  misc_feature: GZ8MTXP02H0HDG.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatctagttctgatctatttcgttggggctggactccggcacgccccgagggagggaagtgggagtggattggtgacgatcctaattatacgtggggcgtacgtactactctccgtccctcaagacgtcgtctcacctagtttcgagggtacacgtaccatacgaccccgcttcctcctagaacctcgaccctccgtcgacccgcccgcggaccaccggtccgttttattccgtgtcgccgtaggcccgagtacttcggtctttacgaaacttccgtaaggtcgggggtcccgtcgggccctaacccgttcgggtcctcgttcggttccctaccgtcgacgtcccttaccgaaccgtaaacggggtccccaggtttccccggtcctttccccccgtggccccgtcccctcgtacccgtcgacgggactccccgttaccgcggtcgggggaccaccggg

SEQ ID NO: 389442 - DNA, 715 bp, Homo sapiens
  misc_feature: GZ8MTXP02I1OA1.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccgcacgccccgaggagggaatggagtggattggtgacatccattatacgtgggacgacgtactactctccgtcctcaagactcgtctcactattcgaggacacgtcatcgaacccgcttctcctagaaactcgtaaccctccgtcgaacccggccgaccggaaccgtaccgggtacccgtttttaagtttcccgtggttcggcggaaggtcggaagtaccgttgggtttactttacctaaaattccgtaagtttacgggggcccgtttcggggaccctaaccccggttcgggtacctaaaccgttcggttccgttaacccttcggtaaacgtcctttacccgaaaaccccggtaaaacggggccccctaagtttaccccggggttccctttcccccccggttgggtacccccgaccccgtttcggcccttaacccgaacggggtaacccgtacccgtaccggtccgggtacgggggacctaacgg

SEQ ID NO: 389443 - DNA, 710 bp, Homo sapiens
  misc_feature: GZ8MTXP02GRZSH.44.23.C01.1.454.CMB.2.raw
  modified_base (324)..(324): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacggcccccgaggggaggggaatgggaggtggagttggtgacagtccattatacgtgggcgtacgtactactctccgtcctcaagngtcgtctcacctagtttcgaggacacgtcatcgaaccccgtcttcctccctagtaaacctcgaaccctccgtacgacccgccggaccggaaccgaccggttccgttttatttccgtgttcggaccggaggaccggtaagtaaccgttcgggtttacctttacgtaaatccgttaacggtcgggggtcccgttcgggacccgttaccccgtcgggttacccgtacgttccgttcccgttcccttaccgtacgtcccgtttaccccgaacccgaaaaccggggtccccctaacggttcccggttacccctttcccccggcggtccccgccccgttcgcccgttaaccgacggaccgacccgtaccgtccggtccgggggcaacccggg

SEQ ID NO: 389444 - DNA, 588 bp, Homo sapiens
  misc_feature: GZ8MTXP02F30DN.44.23.C01.1.454.CMB.2.raw
  modified_base (240)..(240): a, c, t, g, unknown or other
  modified_base (272)..(272): a, c, t, g, unknown or other
  modified_base (309)..(309): a, c, t, g, unknown or other
  modified_base (413)..(413): a, c, t, g, unknown or other
  modified_base (418)..(418): a, c, t, g, unknown or other
  modified_base (439)..(439): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcacatcacttgccgggcgagtcaggttcgttttcggngtctgttgcctggtttacaaacgaaaaggggngacggccccgtaaggtcctcgtctctcgtagaaaccngactgggaaggtacgacgtcccgtcctaggttcagtcgccagtccgagggtggtcgggccccggagtccacgtctcaccattcgcactgaaaccgtctagagtnttcgngctaacttattcgtgtcagtnagtctactatacgtccgtcccttcgtacgtttcggaccggtacggaccagtacgtaagaaaactacgaaaacgtacgtggtacgtctacgacctacacttccgttctaccttctaaccttcccgtccctactactacgtatactttaac

SEQ ID NO: 389445 - DNA, 770 bp, Homo sapiens
  misc_feature: GZ8MTXP02IMF4C.44.23.C01.1.454.CMB.2.raw
  modified_base (329)..(329): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgtatctattcgttggggctggacgtccggacacggccccgaggggagggagtgggaggtggtagttggtgactacgtctattagtacgtgggacgtacgtactctcctcccgtccncaacgacgtctctctacctgtttacggaggtactaccgtccaagtccgtaaacccctccttacctacccgtaacgtaaaccgtccgtaacccgtccgtaccggacccgtacccggaccggtaccgtaccgggtttcccttttacgttttccgtggtcggacggacgggtacggtaaccgtcgttcggttacctttaacgtaacgttcgttaacgggttcgggggtcccgttcggtacccgtacccgttggtacccttacgttccggtcccttcccgttaccgaacggttcccccttaacccgaaccccggtaaaccgggtccccttacggttccccggttcccccgtttccccggccgggtccccctcccggtacccgtacccgcccggtaacggtacccggaccgtaccccggttcggggaccgggaccctaccccgggg

SEQ ID NO: 389446 - DNA, 607 bp, Homo sapiens
  misc_feature: GZ8MTXP02FPFJ0.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacggcccccgagggaggggaatgggagtggattggtgacatccattatacgtggggcgacgtactactctccgtcctcaagagtcgtctcacctatttcgacgggacacgtccatgaaccccgcgttcctaccctgaaactcgacctccgtcgaccgccacggacacgtcgtttattctgtgtcgaggcgagtactggtctttcaacttcgtacgtgggggccgtggacctacccgtggtccacgtcgtccttcctacgtactccttcccaaaccgtaacggcccgtaacgttccggtccctttcccccgcggtcccgtccccgttcgacctcccgaggtaccgccgacccgtcggtccggggacacccgg

SEQ ID NO: 389447 - DNA, 597 bp, Homo sapiens
  misc_feature: GZ8MTXP02FP2P6.44.23.C01.1.454.CMB.2.raw
  modified_base (473)..(473): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccattcagttctgtatctattcgttggggctggatccggcacggcccccgaggggaggggaagtgggagtaggattggtgacatccattatacgtgggcgacgtactactctccgtcctcaacgagtcgtctcaacctactttacggacgggacaccgtaccgatcgaaaccgcttctccctgaaaactcaccgtccgtcgaccgcccgtacggaccgtacggtccgtttatttccgtgtcnccggtaggcgaggtactcggtctttaccaagttcgagttcggggcgttcggctacccgtggtccacgtcgtcctccgtcagtcccttccgaaccgaacggcctacgtccggttccttcccccgg

SEQ ID NO: 389448 - DNA, 830 bp, Homo sapiens
  misc_feature: GZ8MTXP02II7PF.44.23.C01.1.454.CMB.2.raw
  modified_base (242)..(242): a, c, t, g, unknown or other
  modified_base (278)..(278): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttggccggcgagtcagggttcgttttcggngtcttgttgccttggttacaaacggtaaaagggggnacggcccctaaggtccctcgtctctcgtacgaaaccaggactagggaaaggtacgacggttcccccgtcgaaggttcccaaggtcgacccaggtcccgagggttcgggtcggggaccccggtacgtcccacgttctaccaaccctagtttaccggccgtaacccgttcggacccgggtacccttaggaaaacgttcgtttccgtaggtaacccttaaacgttttacttttccgttacgtttaccgaacggtaccgtaaacggttaacttaccgtaaagtttaccggtttacccgttccccccggtttttacccgtttaaacccgggtttttttccgggggaacccccgggtttaaaccggggggaaaccccttaaaacggggttacccggttaaaacgggggtaaaacctttaaacccgaaaaacccggtaaaccgttacgggttacggaccgtttaccggaccctaaacccggtaacttccgttacgtttacccttaccgtaacgtttccccttaaccccggtccctaacttccgttacgttaatttaaac

SEQ ID NO: 389449 - DNA, 668 bp, Homo sapiens
  misc_feature: GZ8MTXP02GWLG5.44.23.C01.1.454.CMB.2.raw
  modified_base (243)..(243): a, c, t, g, unknown or other
  modified_base (444)..(444): a, c, t, g, unknown or other
  modified_base (466)..(466): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcaccatcacttggccgggcgagtcgagggttcgttttcggngtctggttgccttggtttacaaacggaaaagggggtcgacggtacccctaagggtccctcgtctcgtgtacgaaaccagactagggaacggtagacgtcccgtcgtagggttcacggtcgccaggtccgaggggtgggtcgggcccggagtccactctcacctagttcgccgtaccgtggccggtacctggaaagtcttcncgtaccttaactttactttcgngttacaggtacctaagtactactagttacgtccgttaccccgttacttaacgttttcgggaccgtacggggtaacccaaggtcgtaaggtaaactaccggaaaacgtacgtacgttacgggccttacggcctaaacctcgttaccgttcgtacctttaccgaatttccccgttaaccctctaacttcgtaattactttaacg

SEQ ID NO: 389450 - DNA, 568 bp, Homo sapiens
  misc_feature: GZ8MTXP02HSN4S.44.23.C01.1.454.CMB.2.raw
  modified_base (214)..(214): a, c, t, g, unknown or other
  modified_base (530)..(530): a, c, t, g, unknown or other
  modified_base (549)..(549): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatnattcgttgggctggatccggcacgccccgagggacgggatggagtggattggtgacatccattatacgtgggcgacgtactactctccgtcctcagacgtcgtctcactagtttcgaggacacgtcagtcgaccccgtcttcctcctagtaactcgacctccgtcgaccgccgcgtaccgacggttccgtttacttcgtgtacgcgagggcgagtactggttacttacgaatcgtagcggggtcctgcctacgtggcactcgtcctcctgacgtcctaccgacgacggtcctagtcccggttcctcccgcgtcccnccgttcgcctaagacgacncaccgtcggcgggcaccgg

SEQ ID NO: 389451 - DNA, 730 bp, Homo sapiens
  misc_feature: GZ8MTXP02FZQ0Z.44.23.C01.1.454.CMB.2.raw
  modified_base (691)..(691): a, c, t, g, unknown or other
  modified_base (702)..(702): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctatttcgttgggctggactccggcacggccccgagggagggagtggagtggtattggtgactatacctattagtacggtggggacgtacgtacctacctccttcccgtccctacgaaaggtacgtccgtctaccaccttaacgtttaccggaacgggtacctaaccgtcctaaacgtacggtaaaccccccgtcctttaccctaccccgtaacgtaaaaccgttccggtaaccccgttcccgggtaccggaccccggacccgggtacccgggtaacccgtaaccgggtttcccgtttttaacgtttccgtggttcggacggtacgggcgtaacggtacgttcggtttctttactaacgtcgtacggtcggggccgtcggtccgtacccgttggtacctcgttcgtcctcctcacgtcctaccgaccgacggtccctagttcccgtcccgttccccgtcggccctcccgtcgtcccnccggaacggcncccgtaccgtcggacggggaccaaccgg

SEQ ID NO: 389452 - DNA, 614 bp, Homo sapiens
  misc_feature: GZ8MTXP02HOGOI.44.23.C01.1.454.CMB.2.raw
  modified_base (291)..(291): a, c, t, g, unknown or other
  modified_base (319)..(319): a, c, t, g, unknown or other
  modified_base (457)..(457): a, c, t, g, unknown or other
  modified_base (594)..(594): a, c, t, g, unknown or other
  modified_base (611)..(611): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagttccatctagttctgatctattcgttgggctggactccggcacgccccgagggacgggaagtggaggtggtagtggtgacatacattactacgngggcgtacgtactactcctccgtcccanaacgacgtcgtctccactagtttacggaggtacacgtccatacgaccccgtcttctacctagaaactcgtacctccgtcgaccgccgacgtactcggtcctttatcgtgcgtacggagcgtacgtacttggtactttnaacttcgtaggtcggggccgttggacccttcggtcgtctctcgtcctcctctacctccttacccgacgtaaccgggtccctacggttcccgtaccctttccccgcggccctcccgtacgccctaacgacggctaccnccggtcggcggggaccncgg

SEQ ID NO: 389453 - DNA, 769 bp, Homo sapiens
  misc_feature: GZ8MTXP02JHMMY.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggagtttccatcagttctgatcattcgtgggctggatccggcacgcccccgaggggagggacgtgggagtggagtttggtgaactacgtaccctagtttacgtacggtcggggtaccgtaaccggttaccttaaccgttccgttaccccggttccccctacgtaaacccggtacggttccgtaccctacctaacccgtaacgttttccgggacgggggtacctaaccggttacccgtaacgtaccgtaaacccgtccttttacccgtacccctacgtaaaacccgttccgtaaccccgtccggttaccggaaccccgccccggaccgggtaaccgtacccgggttaccgttttaacgtttcgtcggttacggccggtaacgggtccgacggtacgttcgggtttactttaccgaaagttccgttagggtccgggggtccgtcggtaccctacccgttcgggtacctacgttcgttcctaccctcgtaccgtccttaacccgaccgaaccgggtccctaacgtcccggttacccctttcccccgg

SEQ ID NO: 389454 - DNA, 578 bp, Homo sapiens
  misc_feature: GZ8MTXP02IZQFP.44.23.C01.1.454.CMB.2.raw
  modified_base (370)..(370): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctgtatccggcagcccccagggacggggaatgggagtggagttggtgacatccattatacgtggggcgtacgtactactcctccgtccctcaacgagtcgtctacacatttcgngggacacgtccatcgaaccgtcttcctccctagaaacctgaccctccgtgacccgccgcggactacggtccgttatttcgtagtgcgtaggcgaggactacggtctttcaatctagtgggcgtcggtccaccctggtctacgtcgttccgtcctcacgtccttacccgaacccgacgggaccccacgttccggttccctttcccccgg

SEQ ID NO: 389455 - DNA, 629 bp, Homo sapiens
  misc_feature: GZ8MTXP02JC8JE.44.23.C01.1.454.CMB.2.raw
  modified_base (277)..(277): a, c, t, g, unknown or other
  modified_base (433)..(433): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctatttcgttgggctggactccggcacgccccgagggagggaagtgggagtggagttggtgacntctatatacgtgggcgtacgtactactccgtcccgtcctacgaagtgtccgtctacacctagttcgagggactacgtccatacgaacccgtccttcctcctagaacctcgaccctcgtaccgccgtccgacgaccgtacggttcctttatttccgngtcggcgaggcgtagtactgggttaccttataacgttcgtaggttcggggtccgtggcccgtacccgtggtacctacgtcgttcctccttcgacgtcccttaccaaccgtaccgggcctacgttccgtcccctcccgtcggccctacccgtgaccctcgacggaccgtaccgtccgtccggtacggggccacccgg

SEQ ID NO: 389456 - DNA, 720 bp, Homo sapiens
  misc_feature: GZ8MTXP02IPKIB.44.23.C01.1.454.CMB.2.raw
  modified_base (614)..(614): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgtgggctggactccggcacgccccgagggaggagtggagtggatggtgacatcctaattacgtacgtgggaccgagtacctacctccttcccgtacctacaagtacgtccgtctaccacctatttaccggacggtacctaccggtcctaacgtacgtaacccccgtcccttaccgtcccccgtaagtaaaacccgttccggtaacccgttccccgggtaccgacccccggccccgggtacccgggtaacccgtaccggggtttacccgtttttacgtttccgttagggtccggtacgggtaacgggtaccggtacggtacgttccgggtttactttacgaaagttcgtaggtccggggtaccgtgaccctcccggtgtctactccgtcctcctnacgtccttaccgacgtacgggtcctacgttcccggtacccttccccgcggtcccgtccccgtgtcctaacgcggtaccgtccgaccgttcgggcggggaccaccgg

SEQ ID NO: 389457 - DNA, 747 bp, Homo sapiens
  misc_feature: GZ8MTXP02GMOUX.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggacgtccggcacgccccgagggagggaagtgggagtgggtagttggtgacacgtctaagttagtacgtggggacacgtactacctcctccgtccctacaagacgttccgtcctctaacctagtttacggaacgggtaccaccgtaccagtcgaacccccgtcttcctacccgtagtaaaaccgtcgtacccgtccggtcgacccggtccggaccgggtaacctaccgggttaccgtttttatttccgtcggtacggacgacgggtacgaagtccgttgggtttacctttacgtaaacgttcgttacgggtccgggggtcctcgggccctacccgttgggtaccctacgttccgttccttccgtaccgtaacgtccccgttaccaacccggtaacccgggtcccctacgggtttcccggttccccttcccccggtccgggtaccctccccgttcgaccggttaaccccgaagggttccgacccgtacccggtttcgggccgggggaacctaacccggg

SEQ ID NO: 389458 - DNA, 683 bp, Homo sapiens
  misc_feature: GZ8MTXP02I37SO.44.23.C01.1.454.CMB.2.raw
  modified_base (207)..(207): a, c, t, g, unknown or other
  modified_base (241)..(241): a, c, t, g, unknown or other
  modified_base (275)..(275): a, c, t, g, unknown or other
  modified_base (313)..(313): a, c, t, g, unknown or other
  modified_base (510)..(510): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccntcacgttgccgggcagtcagtattcggtttcggntctgtcgtccttggttacaaacggtaaaggggcncggacccctaggtcctcgtactcgtacgtacgaaaccngacgtgggaaggtagacgtcccgtcgtacggtcagtcgcacgtcgtaggggtcggtcggaccccggtacgtccgactcgaccaccgtagttccggcgtacgtgaccgggtcctaggtaaagtcttctacgtacccgtaaactttgtttcgttcgtacgtagtactaagtactcgtaagttccgtccgttacccgttntttaaccgtttcggaaccggtaacgggggtaccctaaggcgttaaacggggaaactaacccgtaaagtaaccggtgtaaacgggtcctacggacctacgttacttaccgtccgtttaccttacgtccgtttccctccccggttactacgttaccgtttaagttaactttaacg

SEQ ID NO: 389459 - DNA, 638 bp, Homo sapiens
  misc_feature: GZ8MTXP02ITNIG.44.23.C01.1.454.CMB.2.raw
  modified_base (532)..(532): a, c, t, g, unknown or other
  modified_base (588)..(588): a, c, t, g, unknown or other
  modified_base (595)..(595): a, c, t, g, unknown or other
  modified_base (619)..(619): a, c, t, g, unknown or other
  modified_base (635)..(635): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccgttcgggaaccctgtctctcatctgcactgtctctggtagttccatctagttctgatctattcgttgggtctggacgtccggcaccggccccggaagggacggggagtaggagtggtagttggtagactatactagttagtacggtgggacgtacgtacctactcctcccgtcctacgaagtcgtaccgtctacactagttcgacggtacacgtccacgtacgaccccgtctcctaccacgtaactcgacctcgtacgccgccgcgacctacggtctttatcctaggtcgcggtaggcgtagtacgttggtacttacgaattccgtaggtccggggtcctacgccgtaccgtcggtactacgttccgtccgtccncgacttaccgtacccaaccgtaacggtcccctggttccccggtccccttccccggngtccccnccgtgcccgtaacgacggtacccnccgacgtcggacgacncgg

SEQ ID NO: 389460 - DNA, 733 bp, Homo sapiens
  misc_feature: GZ8MTXP02GEB4E.44.23.C01.1.454.CMB.2.raw
  modified_base (277)..(277): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctattcgtgggctggactccggcacggccccgtagggacggggaatgggtagtggtagttggngactactcctatacgtacgtggggactacgtactacctcgtcccgtcctcgaagtacgtcgtactcaccgtatttcggacgggactacggtcatcgaaccccgtctacctcctacgaactcgacctccgtcgaccggccgacggtaccgtccggtcttttaattccgtggtcgcggacggtacgtacgtacgttcgggttacctttacgtaaacgtccgttaaggggtccggggcccgttgggaccccttacccggttagggttaccctacgttccgttacccggttcccacgtaccgttcccgttaaccccggtaacccgtaaccggggcccctttaacggttcccccgggtttacccgtttccccccgggtagggcccccttaccccgtcgtaccggtaaccccctaggggtaacccgtccgaacccggtttccgggtacgggacccgtaacgg

SEQ ID NO: 389461 - DNA, 809 bp, Homo sapiens
  misc_feature: GZ8MTXP02HK52R.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaccctgtctctcatctgcacttgtctcgtggtacgtttccatctagttctgtatctagttcgtgggctggactccggcacgcccccggagggagggaacgtggagtggtagttggtagactatacctaagtttacgtacggtaggggaccgttaaccggttaccttaccgtcccgttaccccgttacccctacgaaccggtacgttccgtacctaccctacctaacgtttcggacggggtaacctaccggtacctacgtaccgtaaacccgtctttaccctacccgtaacgtaaaacccgtccgtaaaccccgttccggttacccggaccccggaccccggtaccggtaaccccgttaccgggttacccgttttaacgtttcccgttagggttaccgggacgggttaacgggaccgggttacgggtaaccgtttccgggtttaccttttacgtaaacgtttccgttaacgggttacgggggtcccggtacggtcccgtaccccggttcggttcctaaccgtttccgttccgtaccccgttcgtaaccgttcccttaccccgaaccggtaaacccggcccgttaccgtacccggtttcccccgtttcccccggg

SEQ ID NO: 389462 - DNA, 653 bp, Homo sapiens
  misc_feature: GZ8MTXP02HRREF.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctcgtggtacgtttccatcagttctgatctattcgtgggctggatccggcacgccccgagggacgggaagtggagtggagttggtgactatacctattagtacgtggggacgtacgtactactcctccgtcctacaacgtagtcgtactcactacgttacgcggacacgtcactcgaaccgtcttccctaccctagtaaacctcgaacccgtcccgtacgacccgcccggacggtaaccgtaccgggttccgtttaacgtttcgttcggtcggtacgggtagggccggtaacggtaccgttacgggttcctttacgtaaagttcgttaaggtcgggggtccgtcgggcccgtaccggttcggtactacgttcgttcctcctcgacgtccgtaccgaaccgtacgggccctacgtcccgttcccttcccccgg

SEQ ID NO: 389463 - DNA, 681 bp, Homo sapiens
  misc_feature: GZ8MTXP02HRJL3.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggccaggactggtgaggccgttcgggaaccctgtctctcatctgcactgtctctggtacgtttccatctagttctgatctatttcgtggggtctggacgtccggcacgcccgagggagggagtggagtggagtggtgacatcaattagtacgtgggacgtacgtactactctccgtcctacaagacgtcgtctcactagttacgaggacacgtccagtacgaacccgtcttcctacctacgtaactcgtaccgtccgtacgacccgtccggaccggaaccgtaccggttaccgttttacgttccgtggtacggacggaacgggtcgaacgtaccgttggttacctttaacgaaacgttcgtaagggtccgggggtaccgtcgggtaccctccggttggtaccctacgttcggtacccttcccgacgtaccgtacccttacccgaaaccggtaaccggccctacggttcccggtccctccccggcgtcccgcccttcgaccgttaaccgacggcctaccgtccggccggtcggggaccaccggg

SEQ ID NO: 389464 - DNA, 430 bp, Homo sapiens
  misc_feature: GZ8MTXP02H7KUX.44.23.C01.1.454.CMB.2.raw
  modified_base (185)..(185): a, c, t, g, unknown or other
  modified_base (389)..(389): a, c, t, g, unknown or other
  modified_base (405)..(405): a, c, t, g, unknown or other
  modified_base (419)..(419): a, c, t, g, unknown or other
  modified_base (421)..(421): a, c, t, g, unknown or other
  modified_base (423)..(430): a, c, t, g, unknown or other
tcagacagtatatacacgaccggtgctcgatttagtacacgtgattagggattgggagtagcacaagctacgcggactccgtgaagggccgattcaccatctccagagacaacgccaagaacacgctgtatctgcaaatgaacagtctgagagccgaggacacggctgtgtattactgtgcaagngccggtgcgggagttcggggattgcatactactactacggtatggacgtgtggggccaagggccacgggtcacccgtctcctcagcttccaccaagggcccatcggtccttcccccgtggccgccctgcctccaggacgccacctcgtggggcacgaggccggcccgtggggctgccccgtggtccaacggcttacttcctatntactgtctgagcgggntggaccaggccganangnnnnnnnn

SEQ ID NO: 389465 - DNA, 623 bp, Homo sapiens
  misc_feature: GZ8MTXP02JPVVQ.44.23.C01.1.454.CMB.2.raw
  modified_base (222)..(222): a, c, t, g, unknown or other
  modified_base (296)..(296): a, c, t, g, unknown or other
  modified_base (577)..(577): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctntggtattccatcagttctgatctattcgtggggtctggatccggcacgccccgaggggacgggagtggagtggngttggtgacatccattagtacgtggggacgtacgtactactcctccgtcctacaacgtcgtcgtctctactattcgcggactacgtccagtacgtaaccgtcttaccctccctacgaaccgtcgtaccgtaccgtacgacccggcccgacgggacccgtaccgggttccgtttactttcgtgttcgcggtacggcgtaggtacgtggttactttacagttcgtagtcggggtaccgtggtacccgtaccggttggtaccgtacgttcgttacctccgtacncgtccttacccgacgtacggccctaccgttccgtcccttcccccgg

SEQ ID NO: 389466 - DNA, 567 bp, Homo sapiens
  misc_feature: GZ8MTXP02I17QO.44.23.C01.1.454.CMB.2.raw
  modified_base (383)..(383): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcacgtactactctccgtcctcaagagtcgtctcacatttcgaggcacgtccatcgaacccgcttctccctgaaactgaccctcgtgaccgccgcgacncggtccgtttattctgtgcgaggcgagactggtctttcaatctatggggccgtggccaccgtggtcactgtctcctcacgtcttccacctaacgggccccagttcccggtccttccccccgtgggcccgtaccccgtcgccgttcccgacggaccgtccaccgttccgtcgggggaccaaccgg

SEQ ID NO: 389467 - DNA, 724 bp, Homo sapiens
  misc_feature: GZ8MTXP02GWNO5.44.23.C01.1.454.CMB.2.raw
  modified_base (278)..(278): a, c, t, g, unknown or other
  modified_base (585)..(585): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggtacgttccatctagttctgtatctattcgtgggtctggagtccggctacgccccggagggacgggaagtggagtggtagttgganactactactagttagtacggtgggacgtacgtactaccgttccgtccccgtaccgtacgaacgtacgttccgtacgtaccacctacgtttcggacgggtaccaccgtaccgacgtacgaacccccgtcttacctaccctaacgaacgtaccgtaacccgttccgtaccgtacccggccggtaccgaccgtaccggtttccgttttacgttcgtggtcgcggtacggcgtacgttacgttaccgtttcgtttaacgaaacttcggttacggttccgggggaccgttaccggtacccgtttaacccggngtttaccgaccgtttcggttccctcctacgtccgtaccgttaccgaacccgtaaccggtccctaccgttccgtccccgtcccgtcgggccctccgtactcccgtaacgacgccgaccgtcgtccgcggggactacccgg

SEQ ID NO: 389468 - DNA, 598 bp, Homo sapiens
  misc_feature: GZ8MTXP02FO05M.44.23.C01.1.454.CMB.2.raw
  modified_base (488)..(488): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggagtttccatcagttctgatcattcgttgggctggatccggcacggcccccgaggggacggggaatggagtggagtttggtgacatccattatacgtgggcgacgtactactcctccgtcctcaacgacgtcgtctccactattcgacggggactacgtccagttcgaaacctcgttcctccctagaaactcgacctccgtcgacccgccgacgacacgggtcctttattctgtgcgaggcgtaggtacgtcggttctttanaacttgtacggtcgggggtccgttggcctacccgtggttaccgacgttcggtccttccgtcacgtccttacccgaaccgtacggccctacgtccggttcctttcccccgg

SEQ ID NO: 389469 - DNA, 623 bp, Homo sapiens
  misc_feature: GZ8MTXP02FIR8J.44.23.C01.1.454.CMB.2.raw
  modified_base (322)..(322): a, c, t, g, unknown or other
  modified_base (565)..(565): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttgggctggatccggcacgccccgagggagggagtggagtggagttggtagacatcctattacgtacgtggggaccgacgtactactctcccgtcctacaagngtccgtctcacctagttcggacggtacacgtacactcgaaccccgtccttacctcccgtacaaactcgaccgtccgtcgacccgccgaccgacacggtccgtttacttcgagtcgagacggtcaagtcctggttacctttacgaattaccgtaggtcggggcctggcctacccgtggtacaccgttcgtcctcctacgacgtccttaccgacgaaacggccctagtcccgtacccttccccgngggccctcccgtgaccgtaaccgaggtcgacccgtccgttcgggaccggggccaccgg

SEQ ID NO: 389470 - DNA, 779 bp, Homo sapiens
  misc_feature: GZ8MTXP02FPLGN.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtcctctcatctgcactgtctcgtggtactttccatcagttctgatctattcgttggggctggactccggacacggcccccgaggggacgggaagtgggagtggtagttggtgacactcctattagtacgtggggacgtacgtactacctacctccgtccctacaacgtacgtcgtctacacctatttacggacggggacctaccgtccctaagtaccgtaaacccgttccgtttacccttacccgttacggtaaaacccgttccgaaccccgttacccggtaccggaaacccccggtcccgggtacccgggtaaacccgttacccggggttaccccgtttttaacgttttcccggttaacgggttccggtaccgggtacgggtacccgggtaacgggttaccgtttaccggggtttccttttaaaccgaacgttttaccgtaagggtccgggggtccggtacgggtccctacccggttcgggtcctaacgttccggttccttaccctcgtaccgtaacccgtaccccgtaaaccggaaccggtcccctaacggttcccggttccctttcccccggg

SEQ ID NO: 389471 - DNA, 698 bp, Homo sapiens
  misc_feature: GZ8MTXP02IVJE0.44.23.C01.1.454.CMB.2.raw
  modified_base (266)..(266): a, c, t, g, unknown or other
  modified_base (271)..(271): a, c, t, g, unknown or other
  modified_base (282)..(282): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactagtgaggccttcgggaaccctgtctctcatctgcactgtctctggtagtttccatctagttctgatctattcgttgggctggatccggcacgccccgagggagggagtggagtggntggtnacatctattanacgtgggcgtacgtactactcctccgtcctcaagcgtcgtcgccacctagttacggaggaccacgtccgagtacgaccccgtcctcctaccctagaacctcgacctccgtcgaacccgccggaccggtaccgtacggttccgttttacgttcgtaggttcggcgtaacgggcgtaaacgtcgttacggttctttacgtaagttcgttacggggtcggggtaccggttccgggaccgttacccgttccgggtactacccgttcgttaccccgtcctccgtaacccggtcccttaacccggaacccgtaaacccggggtccctaccgttccccgggtttaccccttccccggtcgggtcccgtccccgtcggtcccgtccgaacggctcccgaccgtccggtacgggggacctaccgg

SEQ ID NO: 389472 - DNA, 721 bp, Homo sapiens
  misc_feature: GZ8MTXP02HKW1F.44.23.C01.1.454.CMB.2.raw
tcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctcgtggtatttccatctagttctgatctattcgttggggctggatccggcacgcccccgagggacgggaatgggagtggagttggtgacatccattatacgtggggcgtacgtacttacctctccgtcctcaacgacgtccgtctacctacctagtttcggacggggtacctaacgtcccgagttccgaaacccgtccgtttcccctacccgtaagtaaacccgttccgtaccccgttacccgttaccggaacccccggtcccggaccgggtaacccgtacccgggtttacccgtttttacgtttccgttcggtaccgggtacgggtacgggtaccggtaaacgggtcgttccggtttacgtttaccgtaaacgtttcgttacgggtcgggggtccgtcggtaccgtccggttcggtactccgttcgttccgtccttcgacgttcccgttaccgaccggtaacccggccctacggttcccgttaccccgtttcccccgg

SEQ ID NO: 389473 - DNA, 672 bp, Homo sapiens
  misc_feature: GZ8MTXP02FRQGI.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcggcccaggactggtgaggccgttcgggaaccctgtctctcatctgcactgtctctggtagtttccatctagttctgatctattcgttgggctggactccggcgacggacccccgagggagggaagtggaggtaggtagttggtagactatacctattacgtaggtcggacgtacctacgtactccgttcctaccgtacaagtacgttccgtctcctacgtacttacggacggactacgtcacgtacgaacccccgtcttacctacctacgaaactcctaccgttccgcgacccgccgaccggtaccgtaccggttccgtttacttcgtcggtcgcgacggacgtacgtacgtcgttcttactagttacgtacggtcgggtaccgtcgccgtacgtcgtacgacgttcgtcctctcgtaacgtccctaccgtaccgaccggtccctacggttccggttccccctcccgtcggtccccgtcccgccgtaccgtaacccgcggaccaccgtaccggtcggtacggggcccaacccggg

SEQ ID NO: 389474 - DNA, 709 bp, Homo sapiens
  misc_feature: GZ8MTXP02GGFYI.44.23.C01.1.454.CMB.2.raw
  modified_base (241)..(241): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaccctgtctctcatctgcactgtctctggtatttccatcagttcngatctattcgttgggctggactccggcacgcccccgagggacgggatggagtgagtggtgactatcattatacgtgggcgtacgtactactcgtccgtcctacaacgtacgtcgtctctacctacgtttcgacggggtacacgtaccagtccgaaccgtccttcctcccgtagaaaccgtcgtacccgtccgtacgacccgcccgtacgggacccgtaccgggttacccgttttacgtttccgtcggttcggtccgggtacgggtaccggtagggtaacccgttcgggtttacctttaaccgtaacgtttcggttaacggttcggggggtacccttcggggtaacccgtacccccggtttggggttccctaccggtacggtttcctacccggtaactccggtaacctttaccccgaaaccggaaaccggggtcccctaacggttcccggttaccccgtttccccccgg

SEQ ID NO: 389475 - DNA, 673 bp, Homo sapiens
  misc_feature: GZ8MTXP02GORHF.44.23.C01.1.454.CMB.2.raw
  modified_base (239)..(239): a, c, t, g, unknown or other
  modified_base (273)..(273): a, c, t, g, unknown or other
  modified_base (311)..(311): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcacatcacttgccgggcagtcaggttcgttttcggngctgttgccttggtttacaaacgaaaaggggganacgggacccctaaaggtcctcgtctctcgtagaaaccngactggaaggtagacgtcccgtcaggtcagcgccagtcaggtggtcgggccccggtagtccacgtctaccacctagttcgccgtaaccgtcggaccggccgtagaaacgtcttctacgtacctaaactttacttccttgttacacgtctaagttactactagttacgttccgttaccccgttacgtttaccgttttcgggacccggtaaccggggtaacctaaacggtaccgtaagggtaaaacttaccgaaaaccggtagtaaccggttcggacgtacggtacctaaccctaattccgttacgttacccttacaaccgtttcccgtttaaccccactaacttccgttacgtaactttaacg

SEQ ID NO: 389476 - DNA, 631 bp, Homo sapiens
  misc_feature: GZ8MTXP02GTQZF.44.23.C01.1.454.CMB.2.raw
  modified_base (304)..(304): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggtccttcgggaaccctgtctctcatctgcactgtctcgtggtatttccatcagttctgatctattcgtgggctggactccgcacgccccgaggggacggagtggagtggtagttggngacacgtctattagtacgtggggactacgtactactcgtccgtcctacgaacgtagtcctactcacctagtttcgacgggtacacgtcactacgaacctcttcctccctagtaacctctacctcgtacgacccgtccgaccggacgtaccgttacgtttacttcgtcggtgccggtacggcgtacggtacgttcgtttacgttactaacgttcgtagggtccggggtcgtcggacccgtaccgttcggtctacgttcgtccttacctcgtacgtaacccttacccgaaccggaaccgtccctacgtttcccggtccctttcccccgg

SEQ ID NO: 389477 - DNA, 687 bp, Homo sapiens
  misc_feature: GZ8MTXP02JW9XN.44.23.C01.1.454.CMB.2.raw
  modified_base (242)..(242): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtcctctcatctgcactgtctctggatttccatcagttcngatctattcgtgggctggatccggcacgccccgagggaggagtggagtggagttggtgactatccattagtacgtggggctacgttacctactcctccgtccctacgaacgtagtccgtctaccactacgtttcgagggaccacggttccattaccgaacccgtcttaccctcccgtaacgaaaccttccgaacccgttccggcgacccgccggtaccggtaaacccgtccgggtttacccgtttagtttccgtcggttaacgtcgggaacggacggtacggtacgttcggttaccttacgaacgttcgttacgttcgggggaccgtcggtacccgtacccgttcggtacctaccgtcggttccctaaacccgttaccgtaccgtaacccgtaccccgaaaccggtaccggtccccgtaccgtttcccggttccccttacccccg

SEQ ID NO: 389478 - DNA, 696 bp, Homo sapiens
  misc_feature: GZ8MTXP02FJSEO.44.23.C01.1.454.CMB.2.raw
  modified_base (242)..(242): a, c, t, g, unknown or other
  modified_base (275)..(275): a, c, t, g, unknown or other
  modified_base (311)..(311): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcttggttgccttggtttacaacgaaaaggggngacggcccctaaggtcctcgtctctcgtagaaaccngactgggaaggtagacgtcccgtcaggttcagtcgccagtccgagggtcgggtcggggccccggtagtccactctacacctagttcgccgaccgtggccggtcctaggaaacgtctttacgtcgtaccttaaacgtttatttcgtcgttacacgtctaagttactacgtaagttacggtcccggttcccccgtttactaccggtttttcgggacccggtaacgggggtaaccccaaggtacgttaacgggtaaaacttaacccgaaaacgggtaaaccgttggtaccgggacttaccggacctaaaccgttacgttaccgtttcggttaccctttaccgtccttacccgtttcccccgtactactttaccgtataactttaaacg

SEQ ID NO: 389479 - DNA, 706 bp, Homo sapiens
  misc_feature: GZ8MTXP02G1LWY.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgtgggctggatccggcacgcccccgagggacgggaagtggagtggagttggtgactatccattatacgtggggcgacgtactactctccgtcctcaacgtacgtcgtctcactatttcgcgggacacgtccatcgaaccgtcttcctccctagtaaactcgaaccctccgtcgacccggtcccgacggacgtaccgggtaccgtttactttccgtggttacggacgggtacggtacggtaacgggtacccggtttaccgtttaaccgaaacgtttcgttaacgggtccgggggtacccggttcgggacccgttaccccggttcgggttacctaaccgttcggtttaacccttcccgttaccgtaccggttacccctttaaccccggaaacccggtaaccccggggtacccctaaccggtttccccggtttacccccgttttcccccggtccccgggg

SEQ ID NO: 389480 - DNA, 750 bp, Homo sapiens
  misc_feature: GZ8MTXP02FQL37.44.23.C01.1.454.CMB.2.raw
tcagacagtatatacacgaccggtgctcgatttagtacacgtgattagggattgggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcgttggggctggatcccggcacgcccccgaggggaggggaagtgggaggtggattggggtagacgtatcctattagtacgtgggacgacgtactacctctcccgtcctacgaagcgtcactctacacctacgtttccggacgggtacaccgtccacgtaccgaacccgtccttcctaccccgtagtaaaccgttcgtaccccgtccgtacggaccccgccgggaccggaaccgtaccgggttacccgttttactttcccgttggttcgacgggtacggaccgtacggtaccgttcgggtttacctttacgaaacgtttccgttaagggttccgggggtcccgggttcggtcccgtaccccggttgggtccctaccgtttcgttcccgttccctcgacgtcccttaccgaacccggaaacccgggtcccctagttccccggttcccgttacccccggtccggttccccgcccgttccgcccgttcccggaacggacccgccccgtaccggttcccggggtacgggggacccg

SEQ ID NO: 389481 - DNA, 605 bp, Homo sapiens
  misc_feature: GZ8MTXP02HGIO3.44.23.C01.1.454.CMB.2.raw
  modified_base (317)..(317): a, c, t, g, unknown or other
  modified_base (329)..(329): a, c, t, g, unknown or other
  modified_base (480)..(480): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggaggggaagtggaggtggagttggtgacatccatatacgtgggcgacgtactactctccgtcctcaagngtctctcacctnttcgaggacacgtcatcgaacccgtctcctcctacaactcgacctccgcgaccgccgcgacctacggtcgtttacttcgtgtcgcgaggcgaagtacgttcggtacttttacgaattcgtagtcggggccgtgggcctaccctgggtaccncttgtcctctcacgtccttaccgaccaacgggtcccagtttcccgggcccctttcccccggcggcccctcccgtcgtacccgcgtacggacctcccgtaccggtcgggacggggaaccgaacggg

SEQ ID NO: 389482 - DNA, 549 bp, Homo sapiens
  misc_feature: GZ8MTXP02FH5V5.44.23.C01.1.454.CMB.2.raw
  modified_base (336)..(336): a, c, t, g, unknown or other
  modified_base (345)..(345): a, c, t, g, unknown or other
  modified_base (367)..(367): a, c, t, g, unknown or other
  modified_base (507)..(507): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggagttggtgacatcctattatcgtggggcgacgtacgtactcnccgtccctnaacgagtcgctcaccatttcgngggacacgtccatgaaccgcttctaccctgaaactcgacctccgtgacccgccgcggacacggccgtttattctgtgtcgaggcgagactgtctttcaatctagtcggggcgtggccacccgtggtcactcgtcctaccnacgccttccaccgaacggccctaacgtccggtctttcccccg

SEQ ID NO: 389483 - DNA, 804 bp, Homo sapiens
  misc_feature: GZ8MTXP02HFTEN.44.23.C01.1.454.CMB.2.raw
  modified_base (259)..(259): a, c, t, g, unknown or other
  modified_base (264)..(264): a, c, t, g, unknown or other
  modified_base (271)..(271): a, c, t, g, unknown or other
  modified_base (275)..(275): a, c, t, g, unknown or other
  modified_base (333)..(333): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctattcgttgggctggatccggcacgccccgagggagggatgggngtggngttggtnactntctattatacggtgggcgtacgtactactcctcccgtcctacaagtcgtcgtctaccnctacgtttcggacggtacctaccgtccagtacgaaccccgtcttacctcccgtagtaacctcgtaccgtccgtaccgtacccggccgccggaccgtacggttccgttttactttccgtaggtaccggtacggacggggtacgtaacggttccgttacgggtttccttttacgaaacggtttccgtacggggtttaccggggggaccccgtttcggggccccgtttaaaccccggttcgggttaccgtaacccgtttcggttcccccttaccggtaccgtaacccgttccgttaacccccgaaaccccggtacccgggtaacccttacccggggttcccccgtttcccggttaccccccggtccgggggtcccccttaccccggtcccgtacccccgttaaccggaccggtaccgggttaccccctaacccgggtttcccgggggaccgggggttacccaaacccccggggg

SEQ ID NO: 389484 - DNA, 818 bp, Homo sapiens
  misc_feature: GZ8MTXP02F7CF2.44.23.C01.1.454.CMB.2.raw
  modified_base (228)..(228): a, c, t, g, unknown or other
  modified_base (251)..(251): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgacccagtctccttccttcctgttcttcttctggttggaggcagcgtcaccatcacgttggccgggngagtcgtaggtttcgttttcggngtcttggttcgtccgttaggtttaacgaaaacgggtaaaaagggggcgacggtaccccgttaagggtccctccggttcctaccgtacggtaacgaaacccgtaggtaacgtagggaacggtacgtaccggtccccgtacgtaggttacacgttcgccgtacggtccgaggggtcgggtccggggaccccggtacgtccaacttcgtaccaacctagttacgccgtaccgtgggcccgtaccgtaggtaaagtacgtttcctacgtaacctttaaaccgttttagtttccgttacggttacaaccgggttactaaaggtttacttaccgtaagtttaccgggttaccccggttcccccgttttaccggtttaaccgggtttttcccggggaacccgggtaaacgggggtaacccctaaggggtaccgttaaaacggggtaaaacttaaccgggaaaacgtaccggttggtacggtaccttacggaccaacccgttattccgttaaccgtttccttaccctaaccgtttaccccgttaccccgaccttattacgtacgtaatttaaccg

SEQ ID NO: 389485 - DNA, 578 bp, Homo sapiens
  misc_feature: GZ8MTXP02JM1NT.44.23.C01.1.454.CMB.2.raw
  modified_base (549)..(549): a, c, t, g, unknown or other
  modified_base (576)..(576): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgagggagggaatgggagtggattggtgacagtccattatactggggcacgtactactctccgtcctcaagagtcgtctcacctatttcgaggacacgtccatgaaccccgtcttctccctagaaactcgacctccgtcgacccgccgcggacacggcctttattcctgtcgcgaggcgagacgtggtctttacaatctagtcgggggccgtggccaccgtgggcctacgtcgtcctccgtcacggtccttaccgaccgaacggccctaacgtccggtccctcccccgtggcccgccctcgcctccgngacgtccaccgtcggtcgggggacccncg

SEQ ID NO: 389486 - DNA, 808 bp, Homo sapiens
  misc_feature: GZ8MTXP02GEQP0.44.23.C01.1.454.CMB.2.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttctgttcttcttctgttggagcagctcacatcacttggccgggcgagtcgtagggtttcgttttcggtgtcgttggttcgtccgttaggtttaaccgaaaacgggaaaaaaggggggacgtaccggtacccccgttaaagggtcccgttacgtccttacgtccggtaacgaaaacccgaggtaacgtaggggaaacggtacgtacgtccccggtacgtaggttcaggttcgaccgtacgtccgaggggtgggtccggggccccggtacgtccactcctaccgaaccgtagtttacggccgtaaccgtcgggacccgggtcctaagtaaacgttctttccgtagtaaccctttaaacttttctttccgttacggttaccaacggttacgtaacgttacttaccgtacgtttaacggttcccccgtacccccgttttacgtttaaccgttttccgggggaaacccgggaaacgggggtaaccctaaacggtaccgggttaaaaggtaaaacttaaccgaaaaaccgggttacgtgggtaacgtccgtacgtacccaaccgttacttcgtttacttacccgtttactaaccgtttccccgttacccccgattacgtacgtttacaaatttaaac

SEQ ID NO: 389487 - DNA, 699 bp, Homo sapiens
  misc_feature: GZ8MTXP02I7WWC.44.23.C01.1.454.CMB.2.raw
  modified_base (376)..(376): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgtatctattcgttggggtctggactccggcaccgccccggagggagggagtgggagtggtagttggtgacatcctaattacgtacggtcggggaccgacgtacctacctcccgtcccgtccctacgaagtacgtccgtctacacgtacgttcggacggaccncgtccagtacgacccgtcttacctcctagaacctccgaccctccgtaccgacccggtccggaccgtaccgtacgggttccgttttagttccgtggtcggcggtacggacgtacgtacgttcggtttacttacgtaagttccgtaggttccgggggtccgtcggtaccctaccgtcggtactccgtcgttcctacctcgtaccgtcccttacccgaaaccggtaccggtccccttacggttccccgtacccgttccccggtcggtcccctacccgttcgacccgtcgacggcgtacccgtaccgtcgggtccggggacaccggg

SEQ ID NO: 389488 - DNA, 678 bp, Homo sapiens
  misc_feature: GZ8MTXP02HY8IW.44.23.C01.1.454.CMB.2.raw
  modified_base (288)..(288): a, c, t, g, unknown or other
  modified_base (315)..(315): a, c, t, g, unknown or other
  modified_base (349)..(349): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctatttcgttggggctggatccggcacgccccgagggagggatggagtggagttggtgacatcctatatacgngggcgacgtactacctctccgtcctanagtacgtcgtctcaacctacgtttcgacggtacncgttaccatacgaaccccgtcttacctcctacgaactccgtacccgttccggtcgaacccggtcccgaccggtaaccgtaccgtaccgtttttacgttctggtcggaccgtacgggggtacgaagttaccgttcggggtttcttttaaccaaagtttccggtaacgggttcgggggtaccgtcggtacccgttaccccgttgggttacctaccgttcgttccctaccgttcacgtttcctaccgaaaacccgcggttcccacggtttcccgccttcccccggtgcccgtcctacgcgtaaccacggtcgacctcgtcgacgggccacgg

SEQ ID NO: 389489 - DNA, 740 bp, Homo sapiens
  misc_feature: GZ8MTXP02HT5PY.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctattctgatctattcgttggggctggactccggcacgccccgagggagggatgggagtggagttggtgacagtaccattacgtacgtggggacgtacgtactactcctcccgtccctacgaaaggtcgtaccgtcctacctaccgtagtttcggacggaccacgtaccagtacgaacccccgtcctttaccctacccctaagtaaaccttccgacccgttcccggtacgtacccggcccggaccggtaccgtacccgggtttcccgtttacgtttcccgtggttcggacggaacgggtccggaaagttccgttaggtttcctttaccgaattccgtacggtcggggtccgtcggtcccgtaccgtggtacctcgtgtaccctccgtcgtaccgtccgttacccgaaccgtaaaccccgggtccctacggttcccgttcccccgttcccccgttcgggccccgtaccccgtcgtaccccgtaacccgggacgaccgtaccccgtacggttcccggtacgggggtacccaacccggg

SEQ ID NO: 389490 - DNA, 604 bp, Homo sapiens
  misc_feature: GZ8MTXP02HF52S.44.23.C01.1.454.CMB.2.raw
  modified_base (270)..(270): a, c, t, g, unknown or other
  modified_base (431)..(431): a, c, t, g, unknown or other
  modified_base (439)..(439): a, c, t, g, unknown or other
  modified_base (519)..(519): a, c, t, g, unknown or other
  modified_base (579)..(579): a, c, t, g, unknown or other
  modified_base (584)..(584): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggactccggcacgccccgagggagggagtgggagtggagttggngacagtcctattatacgtgggacgacgtactactctccgtcctcagtcgtacgtctacactagtttcggaggacctacgtccagtcgaaccccgtcgttcctaccctagtaaactcgacctccgtacgaccgccggaccgacgtccggtcgtttacttcgngtggacgnggacgacgtacttcggtctttacgaagttcgtaggtccggggtccgtacggccctaccgttgtccgtactcgttcctccncgtacgtctaccgacgacggtcctcggttcgtccctcccgtcgccgacctgcgtaaccgnggacnccgtacgtcgcgggctacgg

SEQ ID NO: 389491 - DNA, 628 bp, Homo sapiens
  misc_feature: GZ8MTXP02JX3EW.44.23.C01.1.454.CMB.2.raw
  modified_base (263)..(263): a, c, t, g, unknown or other
  modified_base (356)..(356): a, c, t, g, unknown or other
  modified_base (384)..(384): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggtccttcgggaaccctgtcctctcatctgcactgtctcgtggtactttccatctagttctgatctattcgttgggntggactccggcacgccccgagggagggaatggagtggagttggtgacatcctaattatacgtgggacacgtactactctccgtcctacaacgngtcgtctcactattcgaggacacgtcancgacgtctctcctagaaacctgacctcgtcgaccgccgacgacgacggtccgtttattcgtgtacgcgtaggcgagtacgtcggttactttacaaagttcctaaggtcggggtcgtcgggtccaacccgttgggtaaccactttcggtaacccttcccgtaccgtaacgtccctttaacccgaaaccccggtaaacggggaccccctaacggtttaccccgggtttaccccctttccccccggg

SEQ ID NO: 389492 - DNA, 716 bp, Homo sapiens
  misc_feature: GZ8MTXP02GU97V.44.23.C01.1.454.CMB.2.raw
  modified_base (241)..(241): a, c, t, g, unknown or other
  modified_base (274)..(274): a, c, t, g, unknown or other
tcagacagtatatacacgaccggtgctcgatttagtacacgtgattagggattgggggtcagaccctgtcaggggacagcatgtacatgagggtccccgctcaactcctggggctcctgctgctctggctcccaggttcgagatgtgacatcgagatcgacccagtctccttccttcctgtcttcttctgttggagcagcgtcacatcacgttgccgggcgagtcgagggttcgttttggngcttgttgccttggttacaaacgaaaagggggnacggcccctaaggtcctcgtctctcgtacgaaaccagacgtaggaaggtacgacgtcccgtcgtagttccgagtcgacccgtagtccgagggtcggtcggggccgggtactccccacgtctacacgtagttacgcgaccgtcggaccggtccgtaggaaacgtactttacgtacggtaccttaaacgttttacgtttcctacggtacgtaacggtcctaaaggttactacccgtaagttaccgggttcccgttacccccggttttaccgttaaaccgggtttttccgggggaccccgttaaacggggggtacccctaaagggttacccgtaaaggtaaaacgttacggaaaaaccggttacgtaggttacgggactacgactacgacttctcgttaccttcgacttccgttcccgactacttacagttactacttacgtacg

SEQ ID NO: 389493 - DNA, 590 bp, Homo sapiens
  misc_feature: GZ8MTXP02FQ5V8.44.23.C01.1.454.CMB.2.raw
  modified_base (311)..(311): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggatggagtggagtggtgacatctattatacgtgggcgacgtactactctccgtcctcaagngtcgtctcactattcgaggtacacgtcatcgacccgcttctcctagtaactcgacctcgtcgaccgcgcgacacggtcttattcgtgtgcgagcgagtactggttcttcaatctagtcggggtccgtggccaccgtggtcctacgtcgtcctcctcgtacgtccttaccacccgtaaacgggtcccctaacgttcccggttcccttcccccgtcggtccccgtcccgtcgtcccgtccggacggccgaccgtacccgtcggtacgggggacctaccggg

SEQ ID NO: 389494 - DNA, 721 bp, Homo sapiens
  misc_feature: GZ8MTXP02IRDNA.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatctagttctgatctattcgtgggctggactccggcacggcccccgagggacgggaagtggagtggagttggtacggacactccgtaattacgtacggttcggggacgtacgtactacctccgttccggtacccctcgaaccgtacgtacgtccgtacctacctagtttacggacgggtacctacggtccacgtacgaacccgtcctttcctacccgtactaaaaccgtccgtacccgtcccgtacgacccgcccggaccggaaccgaaccggttccgtttagttcctcggttcggccgtagggaccggtacggtacgttacgggttacctttacgaaacgttcgtaacgggtcggggttcccggtacggtcccgtaacccgttcggggtaacctaccggttcggtaccccttccggtactccggaaccctttacccggaacccgtaccgggacccctaccggtcccgggtttacccctttcccccggg

SEQ ID NO: 389495 - DNA, 692 bp, Homo sapiens
  misc_feature: GZ8MTXP02HKD6N.44.23.C01.1.454.CMB.2.raw
  modified_base (565)..(565): a, c, t, g, unknown or other
  modified_base (632)..(632): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccgttcgggaaccctgtctctcatctgcactgtctcgtggtagtttccatctagttctgtatctattcgttggggctggacgtccggcgaccggacccccggaggggaagggagtgggaggtaggagttggtgacactctattacgtacggtgggacgtaccgtactacctccgtcccgtcctagacgtcgtcgtctacacctagttacggacggaccacgtccatacgaccccgtccttcctacctacaacgtccgtacctccgtacgacccgtccgacgacgtcggttcgtttactcgtaggtcgacgacgggcgtacgtacgtttcggttacttaacgagttaccgtagggtccgggggtaccgttcgggacccttaccggttggtacctcttccgtccttacccngtaccgtcccttaccgaacggtaccgggtccctcggttccggtacccccttcccggtacgggtcccnccccgttgcccggtaacgcggaccgtccgtacccggtcggggaccggggaccctaacggg

SEQ ID NO: 389496 - DNA, 633 bp, Homo sapiens
  misc_feature: GZ8MTXP02GF8WS.44.23.C01.1.454.CMB.2.raw
  modified_base (361)..(361): a, c, t, g, unknown or other
  modified_base (366)..(366): a, c, t, g, unknown or other
  modified_base (411)..(411): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacgccccgagggagggaatgggtagtggagttggtgacagtcattatacgtgggacacgtactactctcccgtcctacaagacgtcgtctcactatttcgaggactacgtcagtcacccgtctcncctanaactcgtacctcgtcacccgccgtcgaccgtcgtcgtttatccgngttacgcgtaaggcgtaactacgttcggttactttacgaagttcctaagggttcgggggcccttagggaccccttccgggtggttaccctaccggttcttccgtcctttcgaacggttcccttaacccggacgtaaaccggtccctagttcccggtccctaccccgggtgaccccgtccttcgacctccggagtccgacctccgtcggaaccggcaacccgg

SEQ ID NO: 389497 - DNA, 563 bp, Homo sapiens
  misc_feature: GZ8MTXP02FORV9.44.23.C01.1.454.CMB.2.raw
  modified_base (308)..(308): a, c, t, g, unknown or other
  modified_base (312)..(312): a, c, t, g, unknown or other
  modified_base (377)..(377): a, c, t, g, unknown or other
  modified_base (445)..(445): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccgagggagggaatgggagtggagttggtgacatccattagtactggggcacgtactactctccgtcctnaagngtcgtctcaccatttcgaggacacgtcatcgaaccccgtctcctccctagaaactgaccctccgnacccgcgcgacacggtcctttattctgtgcgagcgagactggtcttcaatctagtggggccgtggccnccgtgggtcacgtcgtcctctctacgtcctaccgaccgaacgggccctagtccgtcctcccccgtcggcccgccctcgccctcccgaggtaccgccgacccgtcggcggggcaaccgg

SEQ ID NO: 389498 - DNA, 725 bp, Homo sapiens
  misc_feature: GZ8MTXP02FVNJS.44.23.C01.1.454.CMB.2.raw
  modified_base (286)..(286): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggagcagcgtcaccatcacttgccgggcgagtcgtaggttcgttttcggtgtcttgttcgtccgttggtttaccaaaacggaaaaagggggngacggaccccgtaaggtccctcgtctcctcgtacgaaaccagacgtagggaacggtacgacgtcccgtcgtaggttcaggtcgaccgtagtccgaggggtcggggtcgggaccccggtacgtccactctaccaccgtagttacggccgtaccgtcggccgtaccgttaggaaacgtactttcgtacgtaccttaaacctttgtttcgtcgttacacgtacgtaacgtttactacgtaagtttaacggttccccggttacccccgtttacgttaccgggttttaccgggacccgggtaaacgggggtaacccctaaaggtacgtaaacggtaaaactaccggaaaacgtacgtgggtacggtacctgacccaacgttacgttaccttcgtacctttaccaacgtttccctaccccgaatctttccgaagttactttaacg

SEQ ID NO: 389499 - DNA, 610 bp, Homo sapiens
  misc_feature: GZ8MTXP02FRL0S.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaagtggagtggagttggtgacatccattagtacgtgggcgacgtactactctccgtcctcaacgagtcgtctcgacctattcgaggacacgtcatcgaaccccgtcttcctccctagaaactcgacctccgtcgacccgccgccgaccacggtccgtttatttccgtgtcgcgaggcgtagtactggttctttacaattctaggtcggggtccgttggcctacccgtgggtacctacttcgtcctcctcgacgtcctaccgaccgaacggcccctagtccggttcccttccccgtcggtcccgtccctgtacccgccgtaacggtaccgccctacccgttcggccgggggacaacccggg

SEQ ID NO: 389500 - DNA, 709 bp, Homo sapiens
  misc_feature: GZ8MTXP02G4RYZ.44.23.C01.1.454.CMB.2.raw
  modified_base (274)..(274): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggatccggcacgccccggagggagggaagtgggagtggagtggngactatctaattagtacgtgggcgtacgtactactccgtcccgtcctacgaacgtcgttccgtactcctacctacgtttacggaagggacctaccgtaccgtactcggaacccccgtccttacctacctacgtaaacctcgacccgtcccggtacgtacccggcccggtacgaccgtaccgggttccttttagtttcgtcgttcggacggacgggacggtaacggtacgttcggttaccgtttacgtaacgttaccgtacgggttaccggggtccggttccggccgtacccggtcgttccgtaccgttcgtccttcctactcggggggtcctaccgtaccgaccggtccctaccgtccgttcccgtccccgtccggtcccgtcccgtcgtccgtccgacggaccgtccgtaccggtccggtccgggacgacccgg

SEQ ID NO: 389501 - DNA, 589 bp, Homo sapiens
  misc_feature: GZ8MTXP02FISGN.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccgagggagggaatgggagtggagttgggtgacatccattatacgtggggcgacggtactactcctccgtccctcaagagtccgtctccaacctagtttcgagggaccaccgtccaactcgaaccccgtccttcctacctagaaactcgacctccgtcgacccgccgcgaccgacggtcctttatttctgtcgcgaggcgagtacgtcggtcttcatctagtcggggccgtcggcgaccgtgtaccactcgtctcctcagtcctccacgacggccacgtccggtaccttcccccgtcggtccgcccgtcgccctcgacggtacgccgtccgtccggtcgggggacaccgg

SEQ ID NO: 389502 - DNA, 599 bp, Homo sapiens
  misc_feature: GZ8MTXP02JG6R9.44.23.C01.1.454.CMB.2.raw
  modified_base (554)..(554): a, c, t, g, unknown or other
  modified_base (559)..(559): a, c, t, g, unknown or other
  modified_base (575)..(575): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggaggggaagtgggaggtggagttgggtgacatcctattagtacgtggggcgacgtactacctctccgtcctacagacgtcgtctcacctagttcgaggacacgtccatcgaaccccgtcttcctccctagaactcgaccctccgtaccgccgacgaccgacggtctttattcgtgtcgcgtagcgtagtacgtggttccttactaaacttcgtaggtcggggtccgtcggaccgtacccgtcggtcctaccgttgtccctcctcgacgtcctacccaccgacggccctagtcccggtcccttcccgngcccncctacgcctcgaagcncctaccgtcgtcgggaccacgcgg

SEQ ID NO: 389503 - DNA, 688 bp, Homo sapiens
  misc_feature: GZ8MTXP02JY3P0.44.23.C01.1.454.CMB.2.raw
  modified_base (319)..(319): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaatgggagtggattgggtgacatccattagtacgtggggcgacgtactactctcccgtcctacaagngtcatctaccacctagtttacgaggaccaccgtaccataccgaacccgtctttcctacctacgaaaccgttccacccgtccgtcggacccggcccgcgggaaccctacgggttcccgttttatttccgttgtcggcggacggcggagtaccttgggttcctttacgaatttcgtagggtcggggtccgtcggccgtcccgttgggtctacgttcggtcccttaccgtcctacgtccccgttacccgaaacccggtaccgggtcccctacggtttcccccgggttccccttcccccggtacgggtcccccgtcccgttacgcccgttaccgacgggaccctcccgtacccgttccgggacggggaccccg

SEQ ID NO: 389504 - DNA, 785 bp, Homo sapiens
  misc_feature: GZ8MTXP02INONB.44.23.C01.1.454.CMB.2.raw
  modified_base (221)..(221): a, c, t, g, unknown or other
  modified_base (241)..(241): a, c, t, g, unknown or other
  modified_base (276)..(276): a, c, t, g, unknown or other
  modified_base (305)..(305): a, c, t, g, unknown or other
tcagacagtatatacacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggnagtctaggttcgttttcggngcttgttcgccttggtttacaaacgaaaagggggngacggcccctaaggtcctcgtctctgtanaaaccagactggaaggtagacgtcccgtactaggttcagtgccagtccgaggggtggtcggggaccggtacgtcccacgtcctacacctaagttacgccgtaaccgttcggcccgggtcccttaagggaaacggtacttttacctacggtaacccttaaaactttttaacgtttccgttacggtttaacccgagtaccgttaaaggttaacttaaccctaagttaaccggttccggttaccccccgttttaccgttaaccggttttttaccggggacccggttaaacgggggaaccccgtaaaaggtacccgttaaaggggtaaaaccttaaccgaaaaaccggttaaaccgttagggtacgggttaccgttacggaccctaaaccgtaaactttccgttacggttccctttaccgtaaacccgtttccccgttcccccggtaccttaacttcccgtagtaaacctttagtttaaaaccg

SEQ ID NO: 389505 - DNA, 690 bp, Homo sapiens
  misc_feature: GZ8MTXP02GMB2S.44.23.C01.1.454.CMB.2.raw
  modified_base (243)..(243): a, c, t, g, unknown or other
  modified_base (280)..(280): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccagtctccttccttcctgttcttcttctgttggagcagcgtcacatcacgttcggccggcgagtcgaggttcgttttcggngtcttgttcgccgttggtttacaaacggaaaaggggnacggcccgtaaggtcctcgtctcgtcgtagaaccagactagggaagtagacgttcccgtcgaggttcagtcgcgtacgtccgaggtcgggtcggaccccggtacgtccgtaacgtccgtaccgtaaccgttaattccgggaccgtaacccgttcggcccgggtacccgtaggtaaacggttactttccgtacgtaacctttaaacgtttactttcgtcgttacgacgtcgtaagtactactagttcgtcccgtacccgttgttacgtttcggacggtacgggaacctaagtcgtaaggtaaactacgaaaccgtagttcggtacgacgttcgaaccgtaccttacgtccgttctttaccttactaaccgttcccgttaccccgacgtacctttcgtaataccgtttaaag

SEQ ID NO: 389506 - DNA, 627 bp, Homo sapiens
  misc_feature: GZ8MTXP02G54KO.44.23.C01.1.454.CMB.2.raw
  modified_base (605)..(605): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgctactgtctctggtagtttccatctagttctgatctattcgttggggctggactccggcgacgccccgaggggacgggagtgggagtggtagttgggtagactatacctaagttactacggtgggacgtaacgtacctacctccgtcccgtcctacaagtcgtcgtctacacctagtttcggacggacacgtcatacgaccccgtcttcctacctagtaacctcgaccttccgcgaccgccggacgaccgtacggttaccgtttattcgtgtcggagacggcgtagtcttggttcttactagtctaggtcgggtcgtcgacccgtccgtcggtcacttcgtctcctcgacgtcctaccgacgtaacggtccctacgttcccggtcccttacccgtcggcccgtaccgtcgaccgtcgacggcnccgacgtcggacgggaccacgg

SEQ ID NO: 389507 - DNA, 738 bp, Homo sapiens
  misc_feature: GZ8MTXP02F5BG6.44.23.C01.1.454.CMB.2.raw
  modified_base (273)..(273): a, c, t, g, unknown or other
  modified_base (443)..(443): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctatttcgttggggctggacgtccggcacgccccgagggagggagtggagtggagttggngacatcctatagtacgtgggacgtacgtactacctcctccgtcctacgacgtacgtcgtctaccactagttcgacggaccacgtccatcgaaccccgtcttcctacctacgaacctcgaccctccgtcgaccggccgacgtaccgtacggttaccgtttactttccgggngtacggacggtacggtacgtacgtcgttacgtttaccttacgtacgttcggtacgggggtccggggtacccgtcgggtacccccgtaccgtttcgggtacctaccggtttcccgttcccttagttaccccgtaccggttaccctaaccccggaaacgggtacccccgggtacccttaccggtttcccccgggttacccccgttccccgggtccgggtcccgttaccccgttcgacccccgtcgggaaccggtacccgtccccggtacgggttccgggggacccggacgtacccgg

SEQ ID NO: 389508 - DNA, 640 bp, Homo sapiens
  misc_feature: GZ8MTXP02GIQ6G.44.23.C01.1.454.CMB.2.raw
tcagacagtatatacacgaccggtgctcgatttagtacacgtgattagggattggggcagggtgaacacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagtagtagttactacgtgggctggactccgccacgccccgagggacggggctggagtggagttgggagtatctattagtaggtggagcacctactacaccccgtcctacgagacgtcgacgtacaaccgtatactacgagtagaaccaccgtaccaaacgacctacgtttcctacccctagaacgctggaacgctcgtgtccgaccggtccgacggaccgacggtcccgtagtaacgttcgtgtacgacggacgaggtacggcgtacgttacgtaccacctaacgttcgttacgacccgtagtaccgggacctacgggtaacccgtggtccaccgtcgtccctacgacgtccctaccgtaacccgacgggtccccacgttccgtccccgttccccgcggaccctaccccggtacctaccgaagtacccgtacccg

SEQ ID NO: 389509 - DNA, 643 bp, Homo sapiens
  misc_feature: GZ8MTXP02HDVZ5.44.23.C01.1.454.CMB.2.raw
  modified_base (598)..(598): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgatctattcgttgggctggactccggcacgccccgagggacgggatggagtggagttggtagactctctattagtcgtgggctacgtactactcctcctcctgaacgtcgtcgctcacctgttcggagacctacgtccatccgaacccgtcttacctcccgagtaactccgaccgtccgtacgcccggtccgaccggtaccgtaccggtccgtttacttcgtagtcgacggaggtcgaacgttacgttcggttacttacgtaaacgtcgtagggttccggggtcgtcgggtaccctacccggttcgaaccttcgtcgtccctacttcgacgtccttaccgacgtaaccggtccctacgttcccgttcccttccccgcgggtccccnccgtcgccgtaaccgtacgtccgtccgtccgtcggcggaccgcgg

SEQ ID NO: 389510 - DNA, 734 bp, Homo sapiens
  misc_feature: GZ8MTXP02F919E.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgccccgagggagggaatggaggtggagttggtgacgatccattagtacgtcgggcgtacgtactacgtcctccgtccctcaagacgtcgtctcacctactttcggaggtaccacggtaccagtacgaacccctcgttaccgtccctagaaaaccttccgaacccttccgtccgtaacccgcccggtaccgggacccgtaaccgggttcccgttttaagtttccgtagttcgcggagcggtacgtacgttcggttctttacgtaacgttcgttacggttcgggggtccgtttcggcccggtaaccccgtcgggttaccctaccgtttccgttcccgttccgtacccgtaacggttcccctttaacccgaacccggaaaacccggtccctaaccggtttcccccggttcccgtttcccccccggttcgggcccccgtccccgtccggtacccttccgaccggtacgccgtacccgtcgggtacgggggaccacccgggg

SEQ ID NO: 389511 - DNA, 829 bp, Homo sapiens
  misc_feature: GZ8MTXP02IAK9M.44.23.C01.1.454.CMB.2.raw
tcagacagtatatacacgaccggtgctcgatttagtacacgtgattagggattgggggagtcagaccctgtcaggggacagcatggacatgagggtcccgctcagctcctggggctcctgctgctctggctcccaggttcgagatgtgacatcgagatgacccagtctccttccttctgttctttcttctgttggaggcagtcgtcaccatctacgttcggccgggcgagtcgtaggttcgttttcggtgtcgtgttcgccgttggtttacgaaacggaaaaagggggagacggtaccccgtaaaggtccctacgttcttcgtcgtacggaaaaccccaggaccgtagggtaaggtacggaccgttccccgtacgtaggttcaggtcgaccgtacgtaccgaggggttcggggtcggggccccggggtacgttcccgaccttccttacccaacccgtaagtttacgggcccggaacccgtttcgggaccccggtcccgttaggaaacggttactttccgtgttaacccttaaactttttaactttcgtacgttacgaacggtaccttaaggttaacttaccaggtttaaaccggttacccgggttaccccccgtttttacgttacggttttttacccggggaccgggtaaaccgggggtaaaccccaaaggtttcccggtaaaaggtaaaacgttaaccgaaaaaaccggtacgttcgggtaacggtcgttacggcccttaaaacccggttcttaccgttaccgtttccttacgtaacccgtttccccgttacccgtacctaacgttccgttaaacgttaactttaacg

SEQ ID NO: 389512 - DNA, 701 bp, Homo sapiens
  misc_feature: GZ8MTXP02GH9YS.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctcgtggtacgtttccatctagttctgattctattcggtggggctggactccggcacggccgtaccggaggggaaggggaagtgggtaggtggtagttgggtagactatactaagttagtacggtggggacctacgttacctactcctcccgtacctacgacgactcgtcctactaccttagttccgggaacggtacctaccgtcctaacgtacgaaacccgttccttaccctacccgtaacgtaaaccgtccggtaacccttcccggtacccgaccccgggtacccggaccggtaaccgtaccccggtttacgttttaacttcggtacggtcggtacggacgggacgtacgtaccgttcggtttcttactaagtcgtaggtcgggccgtcgtacccgtaccgttgtccgtacgttcgttcccgtctaccgtcgtacccttacccgaccggacggtaccctacggttcccggttcccccg

SEQ ID NO: 389513 - DNA, 652 bp, Homo sapiens
  misc_feature: GZ8MTXP02FQQZ0.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttcctgatctattcgttggggctggactccggcacgcccccgagggagggaagtggaggtggagttggtggactagtacctagttagtacggtggggaccgtacgtactacctcctccgtcccctacgaagtcgtccgtctcacctagtttacggacggactacgtaccactacgaacccgtccgttcctccctacgtaaactccgacccgttccgtacgacccgccgaccgaccgtccggtccgtttattcgtgtcgcgagcgagtacgtgttacgttctagttcgtaggtcggggccgtaggtcctaccgtggtactcgttcgtcctctcgacgtcccttaccgaccgacggaccctacgtcccggttccttcccccgtcgtcccgtccccgtcgacccgtaaccgacggtacgtcccgtaccgtcggccggggactacccggg

SEQ ID NO: 389514 - DNA, 555 bp, Homo sapiens
  misc_feature: GZ8MTXP02GAQDA.44.23.C01.1.454.CMB.2.raw
  modified_base (276)..(276): a, c, t, g, unknown or other
  modified_base (310)..(310): a, c, t, g, unknown or other
  modified_base (407)..(407): a, c, t, g, unknown or other
  modified_base (458)..(458): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttgccttggtttacaaacgaaaagggggnacggcccctaaggtcctcgtctctcgtgaaaccngactggaaggtagacgtcccgtcaggttcagtgccagtccgaggtggtcgggccccggagtccactctcaccattcgcgacctggccgcctgaagtnttctgactaactttattctgtcagctagtatctatacgtcgtccccgtttntacgtttcggccgaggggacccaagcgtaggaaactcgaaagactgcggctgcacactctcgtcttcaacttccttcccgactagtctagatttacg

SEQ ID NO: 389515 - DNA, 599 bp, Homo sapiens
  misc_feature: GZ8MTXP02HELDD.44.23.C01.1.454.CMB.2.raw
  modified_base (457)..(457): a, c, t, g, unknown or other
  modified_base (509)..(509): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggatccggcacgccccgagggagggactgggagtggagtggtgactatcattactacgtgggcacgtctactcctcccgtcctacgacgtcgtcgtctacactagttcggaggtactcgtaccagtcgaccccgtctcctactacgaactcgacctccggtacgaccggtcccgacgaccgtacggtcctttagttcgtagtcggacgagggctagtacgtcgttcttaanaacttcgtaaggtcgggggaccttggcctaccgtgtacgtctccgtctaccntcgtcctaccgacgaccgggtccacggtcccgtacccgtcccgtgcccgtccacgtctccgacggactccgacgttcggcggtacaccgg

SEQ ID NO: 389516 - DNA, 647 bp, Homo sapiens
  misc_feature: GZ8MTXP02GOF93.44.23.C01.1.454.CMB.2.raw
  modified_base (312)..(312): a, c, t, g, unknown or other
  modified_base (577)..(577): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggccaggactggtgacggccttcgggaacctgtctctcatctgctactgtctcgtggtacgtttccattctagttctgtattctattcgttgggctggacgtccggcgacgccccggagggaggagtggagtggtagttggngtactatacgtattagtacggtcgggacgtacgtactcctcctccgtccctagaacgtacgtcgtctacacctagttcgacggacacgtccagtacgacgtccttacctccctacgtaaactcgacccgtccgacgacccgtaccggacgtaaccgtacggttacccgtttacgttcgtacggtcggacggtaggccggtacgtaaccgttcggtttaccttataacgttcgtaggtcgggtacgtcggacctcccggtagtccncgttccgtctacctcgtactccgtaccgaaccggtaccggtaccctcggttcccgtcccgtttcccccgg

SEQ ID NO: 389517 - DNA, 676 bp, Homo sapiens
  misc_feature: GZ8MTXP02I5P7S.44.23.C01.1.454.CMB.2.raw
  modified_base (505)..(505): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgattctatttcgttgggctggactccggcacgccccgagggacgggtaagtggagtggagttggtgacatacctagttagtacggtggggacctacggtaaccttcctccttccgtcccgtacaaggtacgtcgttcctctacccgttagtttccggaagggtacctaccgtacctacgtacgaccccgtaccttccctaccgtacgtaactccgtacctccgtcgacccgtcgaccgacgtcggtcctttattcgagttcgcgaggtcgagtacgttcggttccttaacgtntacgtaggtccggggtccttgggaccctaccgtggtcctaccgtcgtcctacctcgaccgtcctaccgaaaccggcccgtacctccgttcccgttccccgtcccgtcgcccgtcccgtcgtacccgaaccggacgccgtacccgacggttccgggacggtacgaacccggg

SEQ ID NO: 389518 - DNA, 664 bp, Homo sapiens
  misc_feature: GZ8MTXP02FLAP9.44.23.C01.1.454.CMB.2.raw
  modified_base (242)..(242): a, c, t, g, unknown or other
  modified_base (356)..(356): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctctcatctgcactgtctctgagtttccatcagttcngatcattcgttggggctggatccggcacgcccccgaggggaggggaatgggagtggagtttggtgtacgatcctattatacgtggggccgaacgtacgtactcctccgtccctnaacgcgtcgtctcactagtttcgaggaccacggtccaacgtcgaaccgtccttctaccctagaaaaccttcgacccttccgtacgaccccgccggcgaacctacggtccgtttattccgtgtgcggagtcgagtacttgggttctttacgaaacgttcgtaggtcggggtccgtcggaccgtacccggtgggtacctaacggttcgttacccgtcccgttacgaaccggttcccgtttaccccgaaaaccccggtaacccgggggcccccttaaacggttcccccggtttaccgtttccccccccggg

SEQ ID NO: 389519 - DNA, 663 bp, Homo sapiens
  misc_feature: GZ8MTXP02F5AJN.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggactccggctacgccccgagggagggagtggtagtggtagttggtgactatacctagttagtacggtgggacgtacgtactacttcctcccgtacctacaagcgttcgtcctaccacgttacgttacggacggtaccacgtccagtacgaacccctctcctcctacgaactccaccgtccgtacgaccgtccgaccgacctacggttccgtttatttcggtgttacggacggacggtacgtacgtaacgttcggttctttaaacgtagttacgtacggtcggggtacccgtggcccttaccggtgtacccgtcttccggtctcccgtagtaccgtccttacccgacgtaaccggtcctacgttccggtcccttcccgccggtcctacccgtcgaccgtaaccgacggcaccgtcgttcgggccggacaacccggg

SEQ ID NO: 389520 - DNA, 632 bp, Homo sapiens
  misc_feature: GZ8MTXP02IROPM.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatctagttctgatctattcttggggctggatccggcacggcccccgagggaggggaagtggagtggattggtgacatccaatttagtacgtggggacgacgttactactctcccgtaccctacaaacgacgtcgtctcgtacctatttaccgagggggtaccacggtaccatacgaaaccgtcttacccgtccctagaaaacctcgaacctccgtacgacccgacccgcggaaccgacgggtaccgtttaatttcgttggttcggaccggaggtccggtaagtaccgtcggttctttacaaattctagtcggggaccgtgggacctacccgtgggtcacgttcgtcttcctcgactcttacccgaccgaacggtcccacgttccggtccctttcccccgg

SEQ ID NO: 389521 - DNA, 749 bp, Homo sapiens
  misc_feature: GZ8MTXP02GG0BP.44.23.C01.1.454.CMB.2.raw
tcagacagtatatacacgaccggtgctcgatttagtacacgtgattagggattgggggcagggtgaacacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatctattcgttggggctgacgtccggcgacgccccgagggagggaagtgggtagtggtagttggagacatcctaattagtacggtcggggacgtaccgttacctaccgtcctccgtaccctacgaacgtagtccgtctactacctacgttacggacgggtactacgacctataccgacccgtccttcctacctacgtaaccgtcgtaccctccgggtccgacccggccggccgacgtccggttactttacgttcgtagtcgacgtggacgtacgtactcgggtttacttacgtacgttcggtaacggtcgggggtccctcggtaacccttccgggttacggttccagtttcccggtcctaccgtaccggtcgtaccccttaacccgaaccggtaaacggggttccccctaagggtttccccgtcccccgtttaccccgggtcggtaccccggttcccgtacggtacccgttaacccgggacggtaacccggtccccgttaaccggtcggggtacccgggggtaacctaaccccggggg

SEQ ID NO: 389522 - DNA, 696 bp, Homo sapiens
  misc_feature: GZ8MTXP02IX9PI.44.23.C01.1.454.CMB.2.raw
  modified_base (276)..(276): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgtatctattcgttgggctggatccggcacgccccgagggagggaagtggagtggagttggtgacntacctattagtacggtgggaccgtacgtacctacctccgttcccgtccctacgaaggtccgtccgtctaccaccgttacgtttaccggaggtacctaccgtaccagtacgaaccccgtccttccgtaccctaacgtaaaccgtccgtaacccgtccggtccgaccccgtcccggaccgtacccgacggttcctttacgtttgtcgttgacggcggtacgtaacgtacgtcgttactttacgtacttacgtacgtcggggtcccggtcgccgtacccgttcggtactccgttcgtcgtacctcgtaaccgtctacccgtaaccgtacccggtacctccgttcccgttcccgttccccgcgtcccggtccctcgtaccgtccgaacggttcgaccgaccgttccggacgggtcccgacccgg

SEQ ID NO: 389523 - DNA, 738 bp, Homo sapiens
  misc_feature: GZ8MTXP02FXC5P.44.23.C01.1.454.CMB.2.raw
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctcgtggtatttccatctagttctgatctattcgttgggctaggactccggacaccgccccggaggggacgggaagtgggtaggtggtagttggtagacacgtcctagttacgtacggtcggggacgtaacgtaccttaccgtccgtcccgtccctacgaacgtacgtccgtctactacctacgtttacggacgggtaccaccgtacgacgtaccgtaaacccgtcctttaccctacccgtaacgtaaaccttccgtaacccgtcccgtaccgaccccggcccggtaccggtaccgtaaccgggttacccgtttacgtttcggtacggttggacccgggtaggtaccgtacggtacgttcggttactttacgaacgtttcgtaggtacgggggtccgtcggtaccctacccggttgtacctacgttcgtcccgttcccgtaccgtaaccgttccgttaccccgaaccggtaaacccgggtccctacccggttcccggtttaccccctttcccccggg

SEQ ID NO: 389524 - DNA, 798 bp, Homo sapiens
  misc_feature: GZ8MTXP02JRWJ6.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgtatctatttcgttgggctggacgtccggcacggccccgagggacgggaagtggagtggagttggagacatcattatacgtcgggacgacgtactacctctccgtcctagacgtcgtcgtctcactagttacggacggactacgtccagtacgaaccccgtcttcctaccgtacgtaactccgtaccctccgtaccgacccggccgaccgacgtaccggtttaccgttttacgttcgtcggtacgacgggacggtacggtaacgtcgttacggtttcttttaacgaacgtttcgtaacgggttccgggggtcccggttaccggtccgttaacccccggttgggttaaacccgtaccgtttcccggttcccttccccgttaacggtcccgtttaaccccgtttacccccgaaaacccggtaaaccccggggttccccctaaccgggttttccccccgggttcccccgtttcccccccggttcggggtaccccctcccccggttacggtaacccccggttccgaaaacggggacccctccccggtaacccggtccgggggttcgggggaacccctaacccccggggg

SEQ ID NO: 389525 - DNA, 706 bp, Homo sapiens
  misc_feature: GZ8MTXP02FKLFO.44.23.C01.1.454.CMB.2.raw
  modified_base (323)..(323): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctggttggaggcagcgtcaccatcacgttggccgggcgagtcgtaggttcgttttcggtgtcttgttcgtcgttggttacaaacggaaaaggggcgacggaccccgtaaggtcctcgtctctacgtacgaaacngacgtgggaaggtacggacgtccccgtcgacggttcaggtcgccgtacggtccgaggggtcggggtcggggacccggtacgtcccgactccgtacctaccgtaattaccggccgtaacccgtcggacccgggtaccttaggaaacgttctttcgtcgtaaacctttaaactttagtttcctgtaccagtaccgtaagttactacgtaacgtttaacccgttacccccggttatttacccggtttacgggacccggtaaacgggggtaaacctacggtcgtaaacggtaaaactacgaaaacgtacgttgggtacgtacgtcgaccgtacctattccgtcgttactccgtacttcccgttcccactatctagtaactattacgg

SEQ ID NO: 389526 - DNA, 590 bp, Homo sapiens
  misc_feature: GZ8MTXP02FG9FF.44.23.C01.1.454.CMB.2.raw
  modified_base (276)..(276): a, c, t, g, unknown or other
  modified_base (411)..(411): a, c, t, g, unknown or other
  modified_base (431)..(431): a, c, t, g, unknown or other
  modified_base (468)..(468): a, c, t, g, unknown or other
  modified_base (545)..(545): a, c, t, g, unknown or other
tcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgccccgagggagggaatggagtggagttggtagacacncctattagtacgtggggctacgtactactcctccgtcctcaacgacgtcgtctcacctagttcggacggaccacgtccacgtacgaaccccgtcttacctcctacgaaactcgaccgtccgcgaccgccgcgacncggtcctttattctgtgcgngcgaagcgtgttcttacactcgtacgtcggggtccgnggcctccgtggtccactcgtctctacacgctccgacgacggtcccacgtccggtccctccccgtcggcccgtcccgngcccgtccgaacggccgtccgtccgtcggacggggtcaacccggg

SEQ ID NO: 389527 - DNA, 529 bp, Homo sapiens
  misc_feature: GZ8MTXP02G1DGS.44.23.C01.1.454.CMB.2.raw
  modified_base (194)..(194): a, c, t, g, unknown or other
  modified_base (215)..(215): a, c, t, g, unknown or other
  modified_base (253)..(253): a, c, t, g, unknown or other
  modified_base (279)..(279): a, c, t, g, unknown or other
  modified_base (510)..(529): a, c, t, g, unknown or other
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtcgaccgccgcggacgcggctgtgttatttcngtgcgagacggccctggaccngcgagtcgtacctctactactactctcgtggacgtcgnggggccaggggccgcggtcaccgtcncctcacgtcctacccgacgaaccgggcccctacgtccggttccccttcccccgtcggccctaccccgtcctacccgaacgacgtcccaacccgttcgggcggggaccacggacgccggtcccggtggggtcctcggtcccgtagggtaccaacggttaccttaccgtttaccgtaattacgtaccttgtcgtaggacgggtccggcgtacggacgaacggcgtactagagnnnnnnnnnnnnnnnnnnnn

SEQ ID NO: 389528 - DNA, 666 bp, Homo sapiens
  misc_feature: GZ8MTXP02GQ0XQ.44.23.C01.1.454.CMB.2.raw
  modified_base (215)..(215): a, c, t, g, unknown or other
  modified_base (258)..(258): a, c, t, g, unknown or other
  modified_base (270)..(270): a, c, t, g, unknown or other
  modified_base (275)..(275): a, c, t, g, unknown or other
  modified_base (384)..(384): a, c, t, g, unknown or other
  modified_base (430)..(430): a, c, t, g, unknown or other
  modified_base (440)..(440): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatnattctgggctggtatccggcacgccccgagggagggaagtggngtaggagttggngacgntaccgattaacgtcgtaggggactaccggttaactacgtcctcccgtcctagtaacgagtcgtactcacctagtttcgaggtacacgtcaagtcgaacccgtcttaccncacgtaaactcgacctcgtagacccgcgacgacacgtctttattcncgtgcgaagngagtactggtacttacgatacgtgtcgggaccgttgacccgtacccgtggtaacgtacgtccggtctttaaccccgtacgtacgtcccgttaacccgaaccgtaaccggtaccctaccggtttcccggttccccgtttccccggaaccggtccccgtaccccgttacgacccgtaaccggtacggaccgtacccgtacccggtacggttaccggggacctaaccgg

SEQ ID NO: 389529 - DNA, 679 bp, Homo sapiens
  misc_feature: GZ8MTXP02HU22F.44.23.C01.1.454.CMB.2.raw
  modified_base (281)..(281): a, c, t, g, unknown or other
tcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgactctatttcgttgggtctggactccggcacgaccccggagggagggagtgggagtggagtggtgacnctactatacgtacgtgggacgtacgtactactcctcccgtcctacgaacgtacgttccgtctacctaaccgttacgtttacggaacggacctaccgtacctacgtaccgtaccccgtccttccctaccgtaacgtaactccgaccgtcccgtacgacccggccgaccggtacccgtacggtccttttacgtcgtaggtcggtacgcggtcgtacgtacgttcgggtttacttcgaattcgtacgggtcgggtccgttacggtcctaccgttcgtacctcgttacgtcccttctacgtcgttcctacccgaacgtacccgtcctacgttcccgttccctcccgtcggaccctcccgtcgcctaaccgagtaccgccgtaccgtcggaccggctaccggg

SEQ ID NO: 389530 - DNA, 733 bp, Homo sapiens
  misc_feature: GZ8MTXP02JG60G.44.23.C01.1.454.CMB.2.raw
  modified_base (244)..(244): a, c, t, g, unknown or other
  modified_base (324)..(324): a, c, t, g, unknown or other
  modified_base (510)..(510): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcaccatcacgttggccgggcgagtcgtaggttcgttttcggngtcttggttgtccgttggtttacaaaggaaaaggggcgacggtaccccgtaaggtcctcgtctacgtacgtacaaaccgngacgtagggtaaggtacggtaccgtccccgtacgtagggttcacggttcgccgtacggtaccgaggggtcggggtcgggaccccgggtacgtcccaaccgttcctaccgaccttacgttcgggccgacccgttcgggccgtaccgtagaaacgtcttactcgtacgtaactttagtttcttacgtntacgacgtagtactacgtattacggtaccgttcccgtttacgttaccggtttcggtacccgggtaacgggtaaccggtaacgtacggtaacggtaaacgtaaaccgtaaacgtaaacgtacggtacggacgttttttacggacctacccgtacgttaccgttcgttccttacccgttaaccgttcccttacccgtaccgtacgttaccttagtacgtttaacg

SEQ ID NO: 389531 - DNA, 625 bp, Homo sapiens
  misc_feature: GZ8MTXP02F5M4K.44.23.C01.1.454.CMB.2.raw
  modified_base (241)..(241): a, c, t, g, unknown or other
  modified_base (267)..(267): a, c, t, g, unknown or other
  modified_base (448)..(448): a, c, t, g, unknown or other
tcagacagtatatacacgaccggtgctcgatttagtacacgtgattagggattgggggagtcagaccctgtcaggggacagcatggacatgagggtccccgctcagctcctcccggggctcctgctgctctggctcccaggttcgagatgtgacatcgagatgacccagtctccttccttcctgtcttcttctgttggaggcagcgtcaccatcacgttgccggcgagtcaggtcgtttgngctgttgctgttcaacgaaaaggggnaggccctaaggtcctcgtctcgtcgtgaaccagactggaaggtagacgtcccgtcgtaggttcagtcgccgacgtccaggggtggtcgggccccggagtccactctcaccattggccgaaccgtggaccgccttaggaagtacttcgtgtacctaacttatttctcgtacagtactacgtntaccgattacgcgtcccccgttactacgtttgggaccgtaagggcccaaggtcctaagggaaaacttccgaaaacggtacgttaggtcggacgttcgaccaacccttagtcccgtaagttccgttactaacgtacccctttaccggcccctaaagtttcccgaagtacctttaaacg

SEQ ID NO: 389532 - DNA, 752 bp, Homo sapiens
  misc_feature: GZ8MTXP02IY8AJ.44.23.C01.1.454.CMB.2.raw
  modified_base (243)..(243): a, c, t, g, unknown or other
  modified_base (280)..(280): a, c, t, g, unknown or other
  modified_base (320)..(320): a, c, t, g, unknown or other
  modified_base (358)..(358): a, c, t, g, unknown or other
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgttcttcttctgttggaggcagcgtcaccatcacgttgccgggcgagtcaggttcgttttcggngtctgttcgccgttggtttacaaacgtaaaaaggggngacggcccctaaggtcctcgtctcgtcgtacgaaacccgngacgtggaaggtacgacgtccccgtcgaggttcagtcnccgtaacgtccgaggggtgggtcggggccccggtacgtcccacgtccgttcaacccgtagttacggcccgtaaccgtcggcccgggtcccgtaggaagtcttacgtgtaccttaacgtttactttctgtacgacgtcgtaagtactactagttacggtccttccccggtttactaccgtttttccgggaccggtaacgggggaaccctaaaggccgttaagggaaaacttaccgtaaaaaccggtaacgtttaccgggtacggtaccgtaccgtacccgtaaacccgttacgtttaccgttaccggtttcccttttaacccggttaacctttcccccgttttacccccggtacccttaccgtttaccctttaggtttaaacccgtttttaaacg

SEQ ID NO: 389533 - DNA, 692 bp, Homo sapiens
  misc_feature: GZ8MTXP02HBC1X.44.23.C01.1.454.CMB.2.raw
  modified_base (314)..(314): a, c, t, g, unknown or other
tcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatcctgccacgtgtctcgtggtacgtttccatctagttctgactcttattcgtcgggtctggtactccggcaccgccccgagggacggagtcggagtggagttgngacatacctattagtacgtgggacgtacgtacctacctcgtcccgtcctacacgtacgtccgtctaccgtactacgttcggacggtacctacgtccagtaccgtaccgtcctttcccacccgtaataacccgtccgtacccgtcccggtacccgcccgcccgggaccgggtacgtaacccggttcgtttaacgtttcggtacggttacggacggcgggtaaaccggtcgttaacgttccggtttactttacgaacgttccggtcggttaccggggccgttaacgggccccgtacccgtggtcctacggttctaccgtccctacgttacgaaccttacccgaaccgaccggtcctccgttcccgtccctttacccccgg

SEQ ID NO: 389534 - DNA, 706 bp, Homo sapiens
  misc_feature: GZ8MTXP02IP59Q.44.23.C01.1.454.CMB.2.raw
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctagtttcgttggggctgggacgtccggcgaccgacccccggaggggaaggggaagtgggtaaggtggtagtggtagactatactattacgacgtcggggacgtaccgttactacctccgtcctcccgtacagtacgtcgctacaccgtagtttacggacggtacaccgtaccgtaatacggaaccccctccgtttcctacccgtacgaaaccttccgcctcccggtcgacccgccgacgacccgtacggttccttttagttcgtgacgcgacgcgagtcgtgttcttacgatcgtaggtcggggtcctggtccctaccgtgtcctacgttccgtccgttcctcgtcgtcccttaacccgaccggtaaccggtcccgtccggttcccgggtttccccttcccccgggcggttaccccgtcccgttccgtacccgttaacggaccggtacccgtaccccgtaccggttcggggcccgggaacctaccgggg

SEQ ID NO: 389535 - DNA, 698 bp, Homo sapiens
  misc_feature: GZ8MTXP02GERX8.44.23.C01.1.454.CMB.2.raw
tcagacagtatatacacgaccggtgctcgatttagtacacgtgattagggattggggcagggtgaacacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatcattcgttgggctggatccggcacgccccgagggacgggaatgggagtggagttggtggacagtcctagttactacgttcggggacgtaaccgtactaacctccgttcccgtacccgttacgaacgtacgttccgtcgttacctaccgtacgtttaccggacggggtaccaccgttccacgttacgacccccgtcttcccgtacctagtaaccttcgaccgttccgtacgacccggtccggccgtaacgaccgggttaactttctttacgtgtacgacggacgggatacgtacgttcggttctttacaacgttcgtacggtcggggtcccgtagaccgtccgtagtccgtaacttcggtcctccgtcgtaacgccgtttaccgaccgtaaacgggtccctacgttccggttaacccgtccccgtcggtaccccgtccttacgcctaacgacggtacaccgtccgttcggacggggcctaaccgggg

SEQ ID NO: 389536 - DNA, 739 bp, Homo sapiens
  misc_feature: GZ8MTXP02H8NM5.44.23.C01.1.454.CMB.2.raw
  modified_base (563)..(563): a, c, t, g, unknown or other
  modified_base (629)..(629): a, c, t, g, unknown or other
  modified_base (736)..(736): a, c, t, g, unknown or other
tcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctgtagttccatcagttctgactcatttcgtggggctggactcccggcgaccgccccggtagggaaggacgtagggaggtggtagttggtacgacgtacttacctaagttacgtacggtcggggtaccgtaacggtttaacctacccgttaccgttccccgttaccgtaacgtaacgtacgttccgtccgtaaccgtaaccgtttaacgtttaaccgggacggtaaacccgtaccgtaccgacgtaccgtaacccccgttccttacctaccctaacggtaaaccctcgtaccccgttccggggtaccgacccggcccggtaccgaaccgtccgggtttaccgttttacgtttcgtcggcggcgaacgggttnaaccgtggtttacggttctttaacgaagttcgtacggtccggggtcctaccgcccgtaaccgggtnttcgtaccgcgtttcctactacggccttcctaaccggacaaccggttccctagcccgttccccgttcgcgtcccgactcgacctgcgacgtcgccgtcggcggaccncgg

SEQ ID NO: 389537 - DNA, 480 bp, Homo sapiens
  misc_feature: GZ8MTXP01DXC18.13.59.F04.1.454.CMB.2.raw
  modified_base (214)..(214): a, c, t, g, unknown or other
  modified_base (224)..(224): a, c, t, g, unknown or other
  modified_base (385)..(385): a, c, t, g, unknown or other
  modified_base (412)..(412): a, c, t, g, unknown or other
  modified_base (428)..(428): a, c, t, g, unknown or other
  modified_base (430)..(430): a, c, t, g, unknown or other
  modified_base (439)..(439): a, c, t, g, unknown or other
  modified_base (456)..(456): a, c, t, g, unknown or other
  modified_base (461)..(461): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcacgtnacttgccggnagtcacgacattaacacttattagcctggtatcagcagaagccaggagagtccctaaaattattgatctctgctgcgtccgcttgcaaagtcgggggtccatctcggtcagtggcgtggatctaggacagaattcactctcacatcaaccaactgcacccngaagatgttggaagttattactgtcanacctatagtgtgccgntnaatttcggnggaggacaaaggtgacnggatnaacgaactgagcgtcgcgc

SEQ ID NO: 389538 - DNA, 493 bp, Homo sapiens
  misc_feature: GZ8MTXP01DNU57.13.59.F04.1.454.CMB.2.raw
  modified_base (409)..(409): a, c, t, g, unknown or other
  modified_base (469)..(469): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtcccctaaattattgatctctgctgcgtccgcttgcaatcgggggtccatctcggttcagtggcgtggatctaggacagaattcactctcaccatcaccaactgcaccctgaagatgttggggaagtttnttaactgtcagacctatagtggtgcccggctcaattttcggcggtagggccaaaggtgcngatcaaacgaatgtggctgcaacc

SEQ ID NO: 389539 - DNA, 495 bp, Homo sapiens
  misc_feature: GZ8MTXP01A2EQW.13.59.F04.1.454.CMB.2.raw
  modified_base (469)..(469): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacactatttagcctggtatcagcagaagccagggagagtccctaaattatgatctctgctgcgtccgcttgcaactcgggggtccatctcggttcagtggcggtggatctaggacagaattcactctcaccatcaccaacctgcaccctgaacgatgttgggaagttattaactgtcagacctatagtggtgccgctcaattttcggcggtagggccgaaagggtgcgnggatcaaacgaactgtggctgcaacc

SEQ ID NO: 389540 - DNA, 518 bp, Homo sapiens
  misc_feature: GZ8MTXP01EI1U0.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggcagtcacgacattaacacttattagcctggtatcagcagaagccagggagagtaccctaaattatgatctctgctgcgtccgccttgcaacgtcgggggtccagtctcggttcagtggcggtggatcgtaggacagatcactctcaccatcaaccacctgccacctgaagatgtagggtaagtttattactgtacagtacctagtagtggtcgcccgtctcgtaagttttcggcgggtacgggaccgaaggtgcgagaactaacgaaacgtaacgtagtggcttcggctaaccc

SEQ ID NO: 389541 - DNA, 510 bp, Homo sapiens
  misc_feature: GZ8MTXP01CQLYX.13.59.F04.1.454.CMB.2.raw
  modified_base (215)..(215): a, c, t, g, unknown or other
  modified_base (369)..(369): a, c, t, g, unknown or other
  modified_base (385)..(385): a, c, t, g, unknown or other
  modified_base (395)..(395): a, c, t, g, unknown or other
  modified_base (414)..(414): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagtcacgacattaacacttatttagcctggtatcagcagaagccaggagagtccctaaattattgatctctgctgcgtccgccttgcaacgtcgggggtccatctcggttcagtggcggtggatctaggacagaattcactcncacatcaaccaacctncaccctgaanatgttggggaattattacngtcagacctatagtgtcgccgctctaagttttcggcggaagggcccgaaaggtcgacgaggactaacaaacgaaccgtagtggcgtcgcgtaaccg

SEQ ID NO: 389542 - DNA, 486 bp, Homo sapiens
  misc_feature: GZ8MTXP01ESPZG.13.59.F04.1.454.CMB.2.raw
  modified_base (215)..(215): a, c, t, g, unknown or other
  modified_base (226)..(226): a, c, t, g, unknown or other
  modified_base (381)..(381): a, c, t, g, unknown or other
  modified_base (474)..(474): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacactatttagcctggtatcagcagaagccaggagagtcccctaaattattgatctctgctgcgtccgccttgcaactcgggggtccatctcgttcagtggcgtgggatctaggacagaattcactctcacatcaccaactncaccctgaagatgttgggaagttattaactgtcagactatagtgtgccgctcaattttcggcggaggaccgaaggtgcgagatcaaacgaacngtggctgcaacc

SEQ ID NO: 389543 - DNA, 517 bp, Homo sapiens
  misc_feature: GZ8MTXP01DL2LY.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccaggagagtccctaaattattgatctctgctgcgtccgccttgctaaacgtccgggggtccagtctcggttcagtgggcggtggatctaggacagaattcactctcacatcaccaactgcaccctgaagatgttagggaagttattactgtcagactatagtggtgcccgctctaagttttcggcgggtagggacccgaaagggtgcgagactaacgaaaacgaacgtcggtaggcgttggccgaacc

SEQ ID NO: 389544 - DNA, 490 bp, Homo sapiens
  misc_feature: GZ8MTXP01CXM52.13.59.F04.1.454.CMB.2.raw
  modified_base (215)..(215): a, c, t, g, unknown or other
  modified_base (225)..(225): a, c, t, g, unknown or other
  modified_base (385)..(385): a, c, t, g, unknown or other
  modified_base (428)..(428): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccggnagtcacgacataacacttattagcctgtatcagcagaagcaggagagtacctaaattatgatctctgctgcgtccgccttgcaacgtcgggggtccagtctcggtcagtggcggtgatcgtaggacagatcactctcacatcaccacctcgcacctaganatgttaggtaagttattactgtcagactatagtgtcgccgctntaagtttcggcggaggaccgaaggtgcgagactaacgaaacgaacgtagtagctgctaaccg

SEQ ID NO: 389545 - DNA, 492 bp, Homo sapiens
  misc_feature: GZ8MTXP01D1Y4Y.13.59.F04.1.454.CMB.2.raw
  modified_base (226)..(226): a, c, t, g, unknown or other
  modified_base (439)..(439): a, c, t, g, unknown or other
  modified_base (451)..(451): a, c, t, g, unknown or other
  modified_base (467)..(467): a, c, t, g, unknown or other
  modified_base (471)..(471): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacactattagcctggtatcagcagaagccagggagagtccctaaattattgatctctgctgcgtccgccttgcaactcgggggtccatctcggttcagtggcgtgggatctaggacagaaattcactctcaccatcaccaacctgcaccctgaagaatgttaggggaatttattaactgtcagacctatagtggtgccgntccaagtttcgnggaggaccaaggtgcngatnaaacgaatgtggctgctaacc

SEQ ID NO: 389546 - DNA, 481 bp, Homo sapiens
  misc_feature: GZ8MTXP01BWQMH.13.59.F04.1.454.CMB.2.raw
  modified_base (215)..(215): a, c, t, g, unknown or other
  modified_base (226)..(226): a, c, t, g, unknown or other
  modified_base (440)..(440): a, c, t, g, unknown or other
  modified_base (457)..(457): a, c, t, g, unknown or other
  modified_base (462)..(462): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacacttatttagcctggtatcagcagaagccagggagagtccctaaattattgatctctgctgcgtcgccttgcaactcgggggtccatctcggttcagtggcggtgatctagacagaattcatctcacatcaccaacctgcacctgaagatgttggggaagttattactgtcagactatagtgtgccgctcaatttcggnggaggaccgaaggtgcngactnaacgaactgtggctgcaac

SEQ ID NO: 389547 - DNA, 520 bp, Homo sapiens
  misc_feature: GZ8MTXP01B84F4.13.59.F04.1.454.CMB.2.raw
  modified_base (388)..(388): a, c, t, g, unknown or other
  modified_base (398)..(398): a, c, t, g, unknown or other
  modified_base (445)..(445): a, c, t, g, unknown or other
  modified_base (482)..(482): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattatgatctctgctgcgtccgccttgctaacgtccgggggtccatctcggttacagtggcggtggatctagggacagaattcactctcaccatcaccaacgtncaccctgaanatgttggggtaagttattactgtcagtacctatagtggtcgccgctntaagttttcgggcggacgggaccgtaaagggtgacgnggacttaacaaaccgtaacgtggtggctcggctaaccg

SEQ ID NO: 389548 - DNA, 512 bp, Homo sapiens
  misc_feature: GZ8MTXP01BQTTR.13.59.F04.1.454.CMB.2.raw
  modified_base (388)..(388): a, c, t, g, unknown or other
  modified_base (471)..(471): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacactatttagcctggtatcagcagaagccagggagagtccctaaattattgatctctgctgcgtccgccttgcaactcgggggtccatctcgttcagtggcgtggatctaggacagattcactctcaccatcacaactgcaccctganatgttggggaagtttattactgtcagacctatagtggtgccgtctctaagttttcgggcgggtagggccgtaaagggtgacgnggacttaacgaaacgaaccgtggtgggcttggccgaacccg

SEQ ID NO: 389549 - DNA, 498 bp, Homo sapiens
  misc_feature: GZ8MTXP01D3LKJ.13.59.F04.1.454.CMB.2.raw
  modified_base (228)..(228): a, c, t, g, unknown or other
  modified_base (370)..(370): a, c, t, g, unknown or other
  modified_base (384)..(384): a, c, t, g, unknown or other
  modified_base (393)..(393): a, c, t, g, unknown or other
  modified_base (416)..(416): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggnagtcacgacattaacacttattagcctggtatcagcagagccaggagagtccctaaattattgatctctgctgcgtccgcttgctaacgtcgggggtccagtctcggttcagtggcgtgggatcgtaggacagaatcactcncacatcaccaactncacctgaanatgttaggggaattattactgtnagactagtagtggtcgcccgtctctaagtttcgggcggaggaccgaaaggtgagagacaacaacgaacgtgtgctcgcgaac

SEQ ID NO: 389550 - DNA, 519 bp, Homo sapiens
  misc_feature: GZ8MTXP01A1LA1.13.59.F04.1.454.CMB.2.raw
  modified_base (215)..(215): a, c, t, g, unknown or other
  modified_base (384)..(384): a, c, t, g, unknown or other
  modified_base (438)..(438): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagtcacgacattaacacttattagcctggtatcagcagaagccagggagagtccctaaattattgatctctgctgcgtccgcttgcaacgtcgggggtccatctcggtcagtggcggtggatctagggacagaattcactctcacatcaccaaccgtncaccctgaagatgttaggggaattattactgtcagtacctatagtgtgggcccnctcgtaatttcgggacggacgggaccgaaagggttgccgaggaaacgtaacgtaacgtaacgtagtcggcgtcgcgtaacg

SEQ ID NO: 389551 - DNA, 497 bp, Homo sapiens
  misc_feature: GZ8MTXP01E01QU.13.59.F04.1.454.CMB.2.raw
  modified_base (450)..(450): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaaattattgatctctgctgcgtccgccttgcaaactcggggggtccagtctcggtcagtggcggtggatctagggacagaaattcactctcacatcaccaaacctgcaccctgaagatgttgggaagttattactgtcagacctatagtgtgccgctcaatttcggnggagggaccgaaaggtgcgagatcaaacgaactgtggctaagcaacc

SEQ ID NO: 389552 - DNA, 554 bp, Homo sapiens
  misc_feature: GZ8MTXP01EIXUS.13.59.F04.1.454.CMB.2.raw
  modified_base (226)..(226): a, c, t, g, unknown or other
  modified_base (295)..(295): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtccctaaattatgatctntgctgcgtccgcttgcaacgtcgggggtccatctcgttcagtggcgtgatctaggacagaattcactctcacatcacaacctgcacctgaagtatgttgggaagtttattactgtacagaccttataaggttggtcggccccggtctcgtaagtttttcggggacgggtacggggttaacccgaaagggttcgaccgttaggaacgttaaccgaaaaacggtaaccgttgggttaggggccttaacgggcgtaaccccg

SEQ ID NO: 389553 - DNA, 507 bp, Homo sapiens
  misc_feature: GZ8MTXP01DHPX9.13.59.F04.1.454.CMB.2.raw
  modified_base (226)..(226): a, c, t, g, unknown or other
  modified_base (479)..(479): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagagcaggagagtcctaaattatgatctctgctgcgtcccgccttgcctaacgtccgggggtccagtctcggttcagtggcggtgatctaggacagaatcactctcacatcacaactgcacctgaagaatgttggggtaaagttattatgtacagtacctataggtgtcggcccgctgtaacgttttcgggcggtagggacccgaaagggtcgacgnggatcaaacgaatggtggcctgctaacc

SEQ ID NO: 389554 - DNA, 494 bp, Homo sapiens
  misc_feature: GZ8MTXP01DJCOA.13.59.F04.1.454.CMB.2.raw
  modified_base (226)..(226): a, c, t, g, unknown or other
  modified_base (469)..(469): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttatttagcctggtatcagcagaagccagggagagtccctaaattattgatctctgctgcgtccgccttgcaactcgggggtccatctcggttcagtggcgtggatctaggacagatcatctcacatcaccaacctgcaccctgaagatgttggggaagttattactgtcagacctatagtgtggcccgctcaattttcggcggtagggaccgaaagggtgacgngatcaaacgaactgaggctgcaacc

SEQ ID NO: 389555 - DNA, 505 bp, Homo sapiens
  misc_feature: GZ8MTXP01BMI3P.13.59.F04.1.454.CMB.2.raw
  modified_base (226)..(226): a, c, t, g, unknown or other
  modified_base (395)..(395): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgaatctctgctgcgtccgccttgcaactcggggggtccatctcggttcagtggcggtggatctaggacagaattcactctcacatcaccaactgcaccctgaanatgttggggaagtttattactgtcagactagtagtggtgccgtctctaatttcggcggtagggaccgaaggtgcgagataacaaacgaacgtagtggactcggctaaccc

SEQ ID NO: 389556 - DNA, 506 bp, Homo sapiens
  misc_feature: GZ8MTXP01EDUEV.13.59.F04.1.454.CMB.2.raw
  modified_base (296)..(296): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctntgctgcgtccgcttgcaactcgggggtccatctcggttcagtggcggtggatctaggacagaattcactctcacatcaccaactgcaccctgaagatgttagggtaagtttattaactgtacagacctatagtggtgccgtctctaagttttcggcgggacgggttaccgaaagggtgcgaggactcaaaacgaactggtggctgcaacc

SEQ ID NO: 389557 - DNA, 513 bp, Homo sapiens
  misc_feature: GZ8MTXP01DRIW9.13.59.F04.1.454.CMB.2.raw
  modified_base (226)..(226): a, c, t, g, unknown or other
  modified_base (483)..(483): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttatttagcctggtatcagcagaagccagggagagtcccctaaaattattagaatctctgctgcgtccgccttgcaactcgggggtccatctcggtcagtggcgtggatctaggacagaattcactctcacatcaacaaacctgacaccctgaagatgttaggggaaagtttattaactgtcagacctatagtggtggcccgtctcaagttttcggcggtagggacccgaagggtgcgnggatcaaaacgaactggtaggctgcgaacc

SEQ ID NO: 389558 - DNA, 530 bp, Homo sapiens
  misc_feature: GZ8MTXP01DIMSE.13.59.F04.1.454.CMB.2.raw
  modified_base (215)..(215): a, c, t, g, unknown or other
  modified_base (296)..(296): a, c, t, g, unknown or other
  modified_base (388)..(388): a, c, t, g, unknown or other
  modified_base (394)..(394): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagtcacgacattaacacttattagcctggtatcagcagaagccagggagagtccctaaattattgatctntgctgcgtccgccttgctaacgtcgggggtccatctcggttcacgtggacggtgggatcgtaggacagaattcactctcacatcaccaactncacctnaagatgttaggggaagtttattactagtcagtactatagtggtgcccgctcgtaacgtttcgggcggggtaacggaccgaaagggtgacgagaacgtccgaaaaacgtaaccgtaggtgggcttggccgtaaaccc

SEQ ID NO: 389559 - DNA, 414 bp, Homo sapiens
  misc_feature: GZ8MTXP01BHCDU.13.59.F04.1.454.CMB.2.raw
  modified_base (408)..(414): a, c, t, g, unknown or other
tcagtcacgtactacacgaccggtgctcgatttagtacacacacttagggattgggaaatctatcatagtgggaccacctactacagcccgtccctcaatagtcgcgtcaccatgtcagtggacgagcccaagaaccagttctccctgagcctgacctctgtaaccgccgcggactcggccctatacttctgtgcgagagatcgagatgtgtcatcgcggggcacttttgatatctggggccaagggtcgatggtcatcgtctcttcagcctccaccaagggcccatcggtcttccccctggccgccctgctccaggacgcacctccgagacgcacagcgccctgggctcgcctggtcaaggctaacttcctaagtacgtgactgagcggggctggcaggcgcatagnnnnnnn

SEQ ID NO: 389560 - DNA, 502 bp, Homo sapiens
  misc_feature: GZ8MTXP01C28S2.13.59.F04.1.454.CMB.2.raw
  modified_base (215)..(215): a, c, t, g, unknown or other
  modified_base (227)..(227): a, c, t, g, unknown or other
  modified_base (492)..(492): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttggccgggngagtcacgacattaacacttattagcctggtatcagcagaagccagggagagtccctaaattattgatctctgctgcgtccgccttgcaactcgggggtccagtctcggttcagtggcggtggatctaggacagaattcactctcacatcaccaacctgcaccctgaagatgttaggggaagtttattaactgtacagacctatagtggtgcccgctctaattttcggcggagggaccaagggtgcgagataacaaacgaatggnggctgctaac

SEQ ID NO: 389561 - DNA, 524 bp, Homo sapiens
  misc_feature: GZ8MTXP01ERTX6.13.59.F04.1.454.CMB.2.raw
  modified_base (201)..(201): a, c, t, g, unknown or other
  modified_base (215)..(215): a, c, t, g, unknown or other
  modified_base (226)..(226): a, c, t, g, unknown or other
  modified_base (446)..(446): a, c, t, g, unknown or other
  modified_base (477)..(477): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggnagtcacgacattaacacttattagcctggtatcagcagaagccgaggagagtaccctaaattattgatctctgctgcgtccgccttgctaacgtcgggggtccagtctcggttcaggtggcggtgatcgtaggacagatcactctcacatcaccaactgcaccctgaacgatgttaggaagtttattactgtacagtacctagtagtggtcgcccgtctntaagtttcggacgggtagggaccaagggtcncgaggactaacgaaaacgtaaccgtggtgttcgtcgaacgtaacccg

SEQ ID NO: 389562 - DNA, 500 bp, Homo sapiens
  misc_feature: GZ8MTXP01CW8GF.13.59.F04.1.454.CMB.2.raw
  modified_base (452)..(452): a, c, t, g, unknown or other
  modified_base (472)..(472): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttgccgggcagtcacgacattaacacttattagcctggtatcagcagaagccaggagagtaccctaaattattgatctctgctgcgtccgccttgcaacgtcgggggtccagtctcggttcagtggcggtgatctaggacagaatcactctcacatcaccaacctgcacctagaagatgtagggtaagttattactgtacagacctatagtggtcgccgtctctaagtttcggnggtaggccgaaaggtgacgngataacaaacgaactgtggctgctaacc

SEQ ID NO: 389563 - DNA, 506 bp, Homo sapiens
  misc_feature: GZ8MTXP01CCLJI.13.59.F04.1.454.CMB.2.raw
  modified_base (228)..(228): a, c, t, g, unknown or other
  modified_base (495)..(495): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttgccggggnagtcacgacattaacacttattagcctggtatcagcagaagccaggagagtaccctaaattattgatctctgctgcgtccgccttgcaacgtcgggggtccatctcggttcagtggcggtggatcgtaggacagaatcactctcacatcaccactgcaccctgaagatgttggggaagtttattactgtacagacctatagtggtcggccgctcgtaatttcggcgggagggacccgaaagggtgacgaggataacaaagaactggnggctgctaacc

SEQ ID NO: 389564 - DNA, 527 bp, Homo sapiens
  misc_feature: GZ8MTXP01AQV7T.13.59.F04.1.454.CMB.2.raw
  modified_base (201)..(201): a, c, t, g, unknown or other
  modified_base (215)..(215): a, c, t, g, unknown or other
  modified_base (227)..(227): a, c, t, g, unknown or other
  modified_base (386)..(386): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttgccgggnagtcacgacattaacacttattagcctggtatcagcagaagccagggagagtccctaaattattgaatctctgctgcgtccgcttgcaacgtcgggggtccatctcggttcagtggcgtgatctaggacagatcactctcacatcaccactgcaccctnaagatgttaggtaagttattactgtacagtactaataggtgtcggcccgtctctaagttttcggcgggaagggacccgtaaagggtcgaccgaggactaacgaaaaccgtaacgtaggtggacttaacggccgtaaacccg

SEQ ID NO: 389565 - DNA, 504 bp, Homo sapiens
  misc_feature: GZ8MTXP01BRLVO.13.59.F04.1.454.CMB.2.raw
  modified_base (215)..(215): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacacttatttagcctggtatcagcagaagccagggagagtcccctaaattattgatctctgctgcgtccgccttgcaactcgggggtccatctcggttcagtggcggtggatctaggacagaattcactctcacatcaaccaacctgcaccctgaacgatgttgggaagtttattactgtcagacctatagtggtcgccgctctaagtttcggcggtagggaccgaaaggtgcgaggataacaaacgaactgtaggctggcaacc

SEQ ID NO: 389566 - DNA, 507 bp, Homo sapiens
  misc_feature: GZ8MTXP01A8QYY.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgcttgcaactcgggggtccatctcggttcagtggcggtggatcgtaggacagaattcactctcaccatcaccaacctgcaccctgaagatgttggggaagttattactgtacagacctatagtggtgcccgtctcgaattttcggcggtagggaccgaagggtgcgttaggataacaaagaacgtgtggctggctaacc

SEQ ID NO: 389567 - DNA, 509 bp, Homo sapiens
  misc_feature: GZ8MTXP01BWY2D.13.59.F04.1.454.CMB.2.raw
  modified_base (216)..(216): a, c, t, g, unknown or other
  modified_base (227)..(227): a, c, t, g, unknown or other
  modified_base (446)..(446): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtnacttgccgggnagtcacgacattaacacttattagcctggtatcagcagaagccagggagagtaccctaaattattgatctctgctgcgtccgcttgcaacgtcgggggtccagtctcggttcagtggcggtggatcgtaggacagtaattcactctcacatcaccaactgcacctgaagatgttggggaaatttagttactgtacagtacctagtagtggtcgcccgtntcgtaagttttcggcggagggaccgaggtgacgagataacaaacgaactgtggctcgctaacc

SEQ ID NO: 389568 - DNA, 569 bp, Homo sapiens
  misc_feature: GZ8MTXP01B8QD7.13.59.F04.1.454.CMB.2.raw
  modified_base (229)..(229): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacgttggccgggnagtcacgacattaacacttattagcctggtatcagcagaagccagggagagtaccctaaattatgatctctgctgcgtccgcttgctaacgtcgggggtccagtcgtcggttcagtgggcggtggatcgtaggacagattcactctcacatcaccaactgcaccctgaagtatggttagggtaagtttattactggtacaagtacctagttaggtcggtacgggtccccgtcttcgtaagttttccggggacgggtaacgggaccgaaagggttcgaccgttaggaacgttaaccgaaaacggtaaccgttagggttcggacgttcggccgtaaaccccg

SEQ ID NO: 389569 - DNA, 494 bp, Homo sapiens
  misc_feature: GZ8MTXP01ELD2D.13.59.F04.1.454.CMB.2.raw
  modified_base (391)..(391): a, c, t, g, unknown or other
  modified_base (434)..(434): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgcttgcaacgtcgggggtccatctcggttcagtggcgtgatctaggacagtaattcactctcacatcaccaactgcaccctgaanatgtgggtaagttattaactgtcagacctatagtgtgccgctnaattttcggcggtagggaccgaaaggtgcgagataacaaagaactggtggctcgctaacc

SEQ ID NO: 389570 - DNA, 514 bp, Homo sapiens
  misc_feature: GZ8MTXP01D8TOA.13.59.F04.1.454.CMB.2.raw
  modified_base (380)..(380): a, c, t, g, unknown or other
  modified_base (389)..(389): a, c, t, g, unknown or other
  modified_base (431)..(431): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacgttggccgggcgagtcacgacattaacacttattagcctggtatcagcagaagcagggagagtaccctaaattattagatctctgctgcgtccgcttgcaacgtcggggtccatctcggtcagtggcgtggatctagacagatcatctcacatcaccaactncacctgaanatgttaggaagtttatatgttacagcctatagtggtgcccgntctaagtttcgggcggaggggttaccgaaagggtgcgaggttaactaacgaaaacggtaacttacggggcggctcgcgtaacg

SEQ ID NO: 389571 - DNA, 513 bp, Homo sapiens
  misc_feature: GZ8MTXP01BTGKU.13.59.F04.1.454.CMB.2.raw
  modified_base (202)..(202): a, c, t, g, unknown or other
  modified_base (228)..(228): a, c, t, g, unknown or other
  modified_base (441)..(441): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtcacttggccgggnagtcacgacattaacacttattagcctggtatcagcagaagccaggagagtaccctaaattatgatctctgctgcgtccgcttgcaacgtcgggggtccagtctcgttcgagtggcggtggatcgtaggacagattcactctcacatcaccaactgcacctagaagatggttgggtaagtttagttactgtcagacctagtagtggtcggccnctcgtaagtttcggcgggtagggaccgaaagggtgacgaggactaacgaaacgaacgtgaggctgctaaccg

SEQ ID NO: 389572 - DNA, 558 bp, Homo sapiens
  misc_feature: GZ8MTXP01C8OU4.13.59.F04.1.454.CMB.2.raw
  modified_base (195)..(195): a, c, t, g, unknown or other
  modified_base (228)..(228): a, c, t, g, unknown or other
  modified_base (415)..(415): a, c, t, g, unknown or other
  modified_base (544)..(544): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctnttggagacagagtcaccgtcacgttggccgggnagtcacgacattaacacttattagcctggtatcagcagaagccaagggagagtaccctaaattattgatctctgtctcggcgtccgctttgaccgtaacgtccgggggtccagttcctcggttacgaggtggcgggtagagtactagggacagtaacttcactctacaccactaccaacccaacctnacccaacccgttgaaagtattaggttagggtaagtttaataccgtgtaccagtacctagtacgtggtcggccctctcgtaagtttcgggagggtacggaccgaagggtgacgagactaacgaaaccgtnagtcggctgccaac

SEQ ID NO: 389573 - DNA, 518 bp, Homo sapiens
  misc_feature: GZ8MTXP01DJMNA.13.59.F04.1.454.CMB.2.raw
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtccctaaattattgatctctgctgcgtccgccttgcaacgtcgggggtccatctcggttcagtggcgtggatctaggacagattcactctcacatcaccaacctgcacctgaagatgttagggtaagtttattaactgtcagacctagtaagtggtcgcccgctctaagttttcgggcggtacgggacccgtaaagggtgaccgagactaacgaaaacgtaactggtgggctgcgtaaccc

SEQ ID NO: 389574 - DNA, 254 bp, Homo sapiens
  misc_feature: GZ8MTXP01BK5M6.13.59.F04.1.454.CMB.2.raw
  modified_base (253)..(254): a, c, t, g, unknown or other
tcagtcacgtactacacgaccggtgctcgatttagtacacacacttagggattgggacagaattcactctcaccatcaccaacctgcaccctgaagatgttggaagttattactgtcagacctatagtggtggcccgctcattttcggcggagggaccaaggtgcagatcaaacgaactgtggctgcaccatctgtcttcatcttcccgccatctgatagtacgtgactgagcgggctggcaaggcgcatagnn

SEQ ID NO: 389575 - DNA, 505 bp, Homo sapiens
  misc_feature: GZ8MTXP01D5UWH.13.59.F04.1.454.CMB.2.raw
  modified_base (201)..(201): a, c, t, g, unknown or other
  modified_base (226)..(226): a, c, t, g, unknown or other
  modified_base (391)..(391): a, c, t, g, unknown or other
  modified_base (407)..(407): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacactattagcctggtatcagcagagcaggagagtcctaaattattgatctctgctgcgtccgtcttgctaacgtccgggggtccagttctcggttcgagtggcgtggatcgtaggacagatcactctcacatcaaccaactgcacctaganatgttaggaaagtttnttactgtcaagtacctataggtggtcgcctctcgtaagttttcgggcgggtacgggaccgaggtgacgaggataacgaaagaactgcggctgctaacc

SEQ ID NO: 389576 - DNA, 518 bp, Homo sapiens
  misc_feature: GZ8MTXP01D9Q4P.13.59.F04.1.454.CMB.2.raw
  modified_base (228)..(228): a, c, t, g, unknown or other
  modified_base (297)..(297): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggnagtcacgacattaacacttattagcctggtatcagcagaagccaggagagtaccctaaattatgatctntgctgcgtccgccttgcaacgtccgggggtcatctcggttcagtggcgtggatcgtaggacagattcactctcacataccaccacctgccacctagaagtatgttagggaagttattactgtacagtacctagtagtggtcgccgtctcgtaatttcgggcggacgggaccgaaagggtgcgagacgtaacaaaaccgaagtcgtaggctcggctaacccg

SEQ ID NO: 389577 - DNA, 512 bp, Homo sapiens
  misc_feature: GZ8MTXP01APEQY.13.59.F04.1.454.CMB.2.raw
  modified_base (215)..(215): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagtcacgacattaacactatttagcctggtatcagcagaagccagggagagtccctaaattattgatctctgctgcgtccgccttgcaactcgggggtccagtctcggttcagtggcggtggatctagggacagaaattcactctcaccatcaccaacctgcaccctgaagatgttggggaagtttattactgttcagtacctatagtggtggcccgctcaagttttcggcggtacgggaccgaaagggtgcgaggactcaaacgaactggtcgggctgcgtaacc

SEQ ID NO: 389578 - DNA, 573 bp, Homo sapiens
  misc_feature: GZ8MTXP01DNWO2.13.59.F04.1.454.CMB.2.raw
  modified_base (202)..(202): a, c, t, g, unknown or other
  modified_base (229)..(229): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttggccgggnagtcacgacattaacacttatttagcctggtatcagcagaagccagggagagtccctaaattactgatctctgctgcgtccgccttgcaacgtcgggggtccatctcggttcagtggcgtggatctaggacagattcactctcacatcaaccaacctgaccaccctagaaagagttacggttaggggtaacggtttaattactgtacagtacctagtagtgtacggtcccgcgttcgtaagttttcgggacgggtaacggggttacccgaaaagggttcgaccgttaggaacttaaccgaaaaaccggtaaccttaagggttcggacgttcggccgtaaacccg

SEQ ID NO: 389579 - DNA, 569 bp, Homo sapiens
  misc_feature: GZ8MTXP01EGYFP.13.59.F04.1.454.CMB.2.raw
  modified_base (195)..(195): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctnttggagacagagtcaccgtcacgttggccgggcgagtcacgacattaaacacttattagcctggtatcagcagaagccgaggagagtacctaaattattgatctctgctgcgtccgccttgcgtaacgtccgggggtccagtcctcggtcagtgggcggtggatcgtaggacagaattcactctcacatccacacctgccacctgaagtatgttaggggtaacttagttatgtcagtacctagtagtggtcggtcccgtactcgtaagttttccggggcgggtaacggggttaacccgaaagggttcggaccgagggttaaacttaacgaaaaccggtaaccgttggtacgggttacttccggaactaaccccg

SEQ ID NO: 389580 - DNA, 523 bp, Homo sapiens
  misc_feature: GZ8MTXP01EHX5V.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgcttgcaacgtcgggggtccatctcggttcagtggcgtggatctaggacagaattcactctcacatcaaccaactgcaccctgaagatgttagggggtaattagttactgtacagtacctagtagtggtggcccgtctcgtaagttttcgggcgggtacgggaccgtaaagggtgacgaggataacgaaaacgaactggtggacttcggctaacccg

SEQ ID NO: 389581 - DNA, 513 bp, Homo sapiens
  misc_feature: GZ8MTXP01B3UBS.13.59.F04.1.454.CMB.2.raw
  modified_base (226)..(226): a, c, t, g, unknown or other
  modified_base (488)..(488): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttatttagcctggtatcagcagaagccagggagagtccctaaattattgatctctgctgcgtccgccttgcaactcggggggtccagtctcggttcagtggcggtgggatctaggacagaattcactctcacatcaaccaacctgcaccctgaacgatgttaggggaagtttattactgtcagacctatagtggtggcccgtctctaagttttcggcgggtagggaccgtaaaggtgcgagatnaaaccgaatggtagggctgcgaacc

SEQ ID NO: 389582 - DNA, 632 bp, Homo sapiens
  misc_feature: GZ8MTXP01EJEDC.13.59.F04.1.454.CMB.2.raw
  modified_base (232)..(232): a, c, t, g, unknown or other
  modified_base (617)..(617): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcattctcttggagacagacgtcaccgtcacgttggccggganagtcaacgacaattaactacttattagcctggtatcagcaaggaacgaccgaggggaacgacgtacccgttaaaatttattgtaattcctcttcgtctcggtccgttcccgtccgttacgccgtaaccggtccggggggtaccagttccgttcggttaacagggtgggtcgggtgggtactacgtaaggacagtaacttcactctacacactaccaaccacctcgaccacctagaagtatagttagggtaagtttattacgtagtacagtacctagtacggttggtccgggtccctcgttcgtaacggttttcgggacgggtaacgggaccgtaaagggtgaccgttaagacgtaaccgaaaaggtaaccgttgggacggttacncggttaaccgtaacc

SEQ ID NO: 389583 - DNA, 569 bp, Homo sapiens
  misc_feature: GZ8MTXP01ERH94.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggnagtcacgacattaacacttattagcctggtatcagcagaagccagggagagtaccctaaattatgatctctgctgcgtccgccttgcaacgtcgggggtccagtctcggtacagtggcggtgactcgtaggacagaatcactctcacactcaccaacctgaccaccctagaagatggttaggtaagtttatactgttacagtacctagtagtcgggtcggtcccgtcgtctaagttttcccgggacggggtacggggaacccgtaaaggggttcaccggaagttacgtaacgaaaaaccggtaaccgttgggttacggggaccttcgggaacccgtaacccg

SEQ ID NO: 389584 - DNA, 520 bp, Homo sapiens
  misc_feature: GZ8MTXP01EREX4.13.59.F04.1.454.CMB.2.raw
  modified_base (202)..(202): a, c, t, g, unknown or other
  modified_base (229)..(229): a, c, t, g, unknown or other
  modified_base (506)..(506): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtcacgttggccgggnagtcaacgacattaacacttatttagcctggtatcagcagaagccagggagagtaccctaaatttatgatctctgctgcgtccgtcttgcaacgtcgggggtccatctcggttcagtggcgtggatcgtagacagaattcactctcacatcaccaactcgaccacctagaagagtgttagggtaagtttattactgttcagtactatagtggtgtccgctcgtaagttcggttcggacgggacgaacggtgacgagacgaagtaaccccgaagtcgngcgtcgcgtaaccg

SEQ ID NO: 389585 - DNA, 590 bp, Homo sapiens
  misc_feature: GZ8MTXP01BYY9V.13.59.F04.1.454.CMB.2.raw
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctctgctgcgtccgcttgcaactcgggggtccagtctcgttcagtggcggtggatctaggacagaattcactctcaccatcaaccaacctcgcaccctgaacgatagttaggggaaagtttatttaacgtcgtacaacgtaccttaagttaaggttcggttcgggtaccccttcgttacgtaacgttttttccgggacggggttaacggggaacccgtaaaaggggttcgaccgttaagaagttaaccgaaaacggtaaaaccgttggtacgggttcgttaacggccgtaaacccg

SEQ ID NO: 389586 - DNA, 536 bp, Homo sapiens
  misc_feature: GZ8MTXP01CGR99.13.59.F04.1.454.CMB.2.raw
  modified_base (201)..(201): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttgccgggnagtcacgacattaacacttattagcctgtatcagcagagccgaggagagtacctaaattattagtatctactgctcgtccgtcgccttgcgtaacgtcgggggtccagtcgtcggttacaggtggcggtgatacgtaggacagtatcactctcacataccactaacctgccaccagaagtataggttagggtaacgtttattactcgtactacgactatacggtgtcgcccgtctcgtaacgtttcgggacggtagggaaccgtaagggtgacgagactaacaaacgtaacgtgtggacctgcctaacc

SEQ ID NO: 389587 - DNA, 578 bp, Homo sapiens
  misc_feature: GZ8MTXP01C4RIQ.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggnagtcaacgacaattaacacttattagcctggtatcagcagaagcgaggagagtacctaaattattgatctctgctgcgtccgcttgcaacgtccgggggtcctacgtcgtcggttacgtaggtgggtcgggtgggtatacgtaggacagtaactcactctcaccatacaaccctaacctcgaccaccctagaaacgtagttaggttaggggtaaagtttaacttactagtactaagtaaccttagtacggtgggtcggcccgtcttcgtaacggttttcgggacgggtacgggaccgtaaggtgaccgagaacttaacgaaaacgtaacgtgggtacgcttcggctaaccg

SEQ ID NO: 389588 - DNA, 541 bp, Homo sapiens
  misc_feature: GZ8MTXP01BY948.13.59.F04.1.454.CMB.2.raw
  modified_base (215)..(215): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggngagtcacgacattaacacttattagcctggtatcagcagagccgagggagagtaccctaaattatgatctctgctgcgtccgcttgcgaacgtcggggtcagtcgtcgtacagtggcggtgatcgtagacagaattcactctacacatcaccaactcgacacctgaacgatagttaggggaatttattactgttacagacctagtaggtggttcggcccgtcttctaacggttttcggacgggacgggttaccgaaacgggttgaaccgttggactaacgaaaaccgtaacgtggttgggacttcggcgtaaccc

SEQ ID NO: 389589 - DNA, 633 bp, Homo sapiens
  misc_feature: GZ8MTXP01CZZX9.13.59.F04.1.454.CMB.2.raw
  modified_base (216)..(216): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagactagagtcaccgtnacttggccgggcagtcacgacataacactattagcctggtatcagcagaagccagggagagtaccctaaaattattgaatctctgcttgcgtccgcttgcgaacgtcgggggtccagtctcggttcaggttcggggtcggtagtactacgtaggacagtaactactactctacaacctactacccaaccctaaccgtacgacctaaccgtagtaagtagttaggttaaggggttaaagtttaacgttacgtacgtacgtaacgtaacgttaacgttacggttacggtccggtacccgtaccgtcgttaacggtttacgggttacgggtaacgggttaaccggtaaacggtacggacgaacgttaacgtaaacgtaaacgtaacgtacggtacggttacgtaacgttaaccgtaaccg

SEQ ID NO: 389590 - DNA, 598 bp, Homo sapiens
  misc_feature: GZ8MTXP01DP1EZ.13.59.F04.1.454.CMB.2.raw
  modified_base (202)..(202): a, c, t, g, unknown or other
  modified_base (287)..(287): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatcctccctgtctgcatctctgganacagacgtcaccgtcacgttcggccgggcgaagtccaacgactaattaactacttaattagcctaggtatcagcagaagcagganacgtacctaaattattgatctctgctgcgtccgtctgcgtaacgtccggggtcctagtcgtcggtacgaggtgggcggtggatacgtaggacagtaaacttcactctacactactacaaccaactcgcctaccgagaagtagtgttaggggtaatttattacgtcgtacgtaacgtaccgttaagttacggttggttccggaccccgttcgtacgttaacggtttcggggacggggacggttaaaccgtaaacgggtgaaccgttagaacgtaaccgtaaaacgtaacttgggtacggcttcgcctaaccg

SEQ ID NO: 389591 - DNA, 563 bp, Homo sapiens
  misc_feature: GZ8MTXP01B6T2Z.13.59.F04.1.454.CMB.2.raw
  modified_base (276)..(276): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccaggganagtccctaaattattgatctctgctgcgtccgcttgcaacgtcgggggtccatctcggttcacgtggcggtgatctaggacagatcactctcacatcaccaactgcacctgaagatgttaggggtaagtttattactgtcgagtaccctataacggtggttcggccccgtcttcgtaacgtttttcggggacgggtaacggggacccgtaaaggggtcgaccgagggaacttaaccgaaaaacggtaaaccttcgggtagggttccgttaacggaaccgtaaccccg

SEQ ID NO: 389592 - DNA, 544 bp, Homo sapiens
  misc_feature: GZ8MTXP01C9QLX.13.59.F04.1.454.CMB.2.raw
  modified_base (215)..(215): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacgttgccgggnagtcacgacattaacacttattagcctggtatcagcagaagccagggagagtccctaaattattgatctctgctgcgtccgccttgcaacgtccgggggtccatctcggttcagtggcggtgatctaggacagattcactctcacatcaccactgcacctgaagatgttaggggaagtttattaactgtcagtaccgttagtaacgtggtcggcccgtcgttctaagtttttcggggcgggtacggggttacccgaaagggttcgccgaggattaaccgaaaacggtaaccgttggtcgggcttcggccgtaacccg

SEQ ID NO: 389593 - DNA, 521 bp, Homo sapiens
  misc_feature: GZ8MTXP01BNTTM.13.59.F04.1.454.CMB.2.raw
  modified_base (230)..(230): a, c, t, g, unknown or other
  modified_base (451)..(451): a, c, t, g, unknown or other
  modified_base (454)..(454): a, c, t, g, unknown or other
  modified_base (465)..(465): a, c, t, g, unknown or other
  modified_base (487)..(487): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagagtcaccgtcacgttggcccgggnagtcaacgacattaacacttattagcctggtatcagcagaagccagggagagtccctaaattattgatctctgctgcgtccgcttgctaacgtcgggggtccagtctcggtcagttggcgtggatcgtagggacagaatcactctcaccatcaaccaactgcacctgaagattacgttggggtaatttattaacgtgttacagtactatagtggtcggccnctntaagtttcggngggtacgggaccgtaaagggtnagacgataacgaacgtaacgtgtgcgtcgcgtcg

SEQ ID NO: 389594 - DNA, 519 bp, Homo sapiens
  misc_feature: GZ8MTXP01DRHZA.13.59.F04.1.454.CMB.2.raw
  modified_base (397)..(397): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacactattagcctggtatcagcagaagccagggagagtaccctaaattattgatctctgctgcgtccgcttgctaacgtcgggggtccagtctcggttcagtgggcggtggatctaggacagaaacttcactctcaccatcaccaacctgcacccngaacgattgttaggggtaaagtttattactgtcaagtacctagtagtggtcggcccgtctctaagttttcggcgggtagggaccgaaggtgacgagataacaaagaactgagctgcgtaacc

SEQ ID NO: 389595 - DNA, 573 bp, Homo sapiens
  misc_feature: GZ8MTXP01AEPNA.13.59.F04.1.454.CMB.2.raw
  modified_base (275)..(275): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagatcaccgtcacttgccgggcagtcacgacattaacacttatttagcctggtatcagcagaagccaggganagtccctaaaattattgatctctgctgcgtccgcttgcaagtcgggggtccatcgtcggttcaggtggcggtgggatcgtagacagtaatcatctcacatcaccactgcacctgaagatgtagggtaattagttactgtccagtacctagtagtggtcggtaccccgtcgttcgtaacgtttttcggggccgggtaaacggggacccgaaaaggggttcgacccggttaggaaacgttaaccgaaaaccggtaaaccgtttcgggtaggggttaccttcgggaacccgttaaaccccg

SEQ ID NO: 389596 - DNA, 501 bp, Homo sapiens
  misc_feature: GZ8MTXP01BJCSE.13.59.F04.1.454.CMB.2.raw
  modified_base (201)..(201): a, c, t, g, unknown or other
  modified_base (215)..(215): a, c, t, g, unknown or other
  modified_base (226)..(226): a, c, t, g, unknown or other
  modified_base (417)..(417): a, c, t, g, unknown or other
  modified_base (473)..(473): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggnagtcacgacattaacacttatttagcctggtatcagcagaagccagggagagtccctaaattatgatctctgctgcgtccgccttgcaacgtcgggggtccatctcggttcagtggcgtggatcgtaggacagaattcactctcaccatcaccaactgcaccctgaagatgttggggaattagttactgtnagactatagtggtggcccgctctaagtttcggcgggtaggaccgaaagggtgacgngataacaaagaactgtaggctgcgtaac

SEQ ID NO: 389597 - DNA, 513 bp, Homo sapiens
  misc_feature: GZ8MTXP01C8INY.13.59.F04.1.454.CMB.2.raw
  modified_base (202)..(202): a, c, t, g, unknown or other
  modified_base (230)..(230): a, c, t, g, unknown or other
  modified_base (289)..(289): a, c, t, g, unknown or other
  modified_base (297)..(297): a, c, t, g, unknown or other
  modified_base (390)..(390): a, c, t, g, unknown or other
  modified_base (398)..(398): a, c, t, g, unknown or other
  modified_base (420)..(420): a, c, t, g, unknown or other
  modified_base (445)..(445): a, c, t, g, unknown or other
  modified_base (478)..(478): a, c, t, g, unknown or other
  modified_base (483)..(483): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcgttgganacagacgtcaccgtcacgttggccgggnagtcacgacattaacacttattagcctggtatcagcagagcaggagagtacctaaattntagatctntgctgcgtcgaccttgacaacgtcgggggtccagtctcggttcgagtggtcggtggattcgaggacagtaattcactcacacatcacaaccgnacaccgtnaagatgttaggggtattattangtacagtactagtagtgtcgccgtntccgtgtttcggcgggtaaggccgaaggggtanacganacaacgaacgtaacgtgtgcgtcgcgtaac

SEQ ID NO: 389598 - DNA, 529 bp, Homo sapiens
  misc_feature: GZ8MTXP01CC18T.13.59.F04.1.454.CMB.2.raw
  modified_base (201)..(201): a, c, t, g, unknown or other
  modified_base (215)..(215): a, c, t, g, unknown or other
  modified_base (226)..(226): a, c, t, g, unknown or other
  modified_base (488)..(488): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggnagtcacgacattaacacttattagcctggtatcagcagagccaggagagtccctaaatattgatctctgctgcgtcgccttgcaacgtcgggggtccatctcggttcagtggcggtgatctaggacagaaattcactctcacatcaccaactgcaccctgaagagtgttaggggaagtttattaactgttacagtaccgtagttaggtggtcggcccgtcttctaagttttcggcgggtaacgggaccgaaagggttgacgngataaccgaaaacgaaccgttggtcggcttcggctaacccg

SEQ ID NO: 389599 - DNA, 525 bp, Homo sapiens
  misc_feature: GZ8MTXP01D4YCY.13.59.F04.1.454.CMB.2.raw
  modified_base (226)..(226): a, c, t, g, unknown or other
  modified_base (241)..(241): a, c, t, g, unknown or other
  modified_base (371)..(371): a, c, t, g, unknown or other
  modified_base (383)..(383): a, c, t, g, unknown or other
  modified_base (454)..(454): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtcacttggccgggnagtcacgacataacncttattagctggtatcagcagagcaggagagtacctaaattatgatctctgctgcgtccgcttgcgaacgtcgggggtccatcgtcggtcagtggcgtgggatcgtaggacagaacttcactctcactancaaccaacctcncaccctagaagattaggttagggtaagtttaattaccgtagtcaagactagtaggtgttcggcccgtcgtntaacgtttcggacgggtacgggaccgaaggtgacgagactaacgaaacgaacgttggaggcctgcgtaacc

SEQ ID NO: 389600 - DNA, 522 bp, Homo sapiens
  misc_feature: GZ8MTXP01B9Q60.13.59.F04.1.454.CMB.2.raw
  modified_base (201)..(201): a, c, t, g, unknown or other
  modified_base (215)..(215): a, c, t, g, unknown or other
  modified_base (225)..(225): a, c, t, g, unknown or other
  modified_base (449)..(449): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccggnagtcacgacataacacttattagcctggtatcagcagaagccagggagagtaccctaaattattgaatctctgctgccgtccgcttgcaacgtccgggggtccatctcggttacaggtggcggtggattcgagacagaactcatctcacatcacaacctgaccacctagaagattagttagggaagtttattacctgtacagtacctagtagtcggtcgcccgngtcctaagttttcggcggtaggaccgtaaggtgacaggataacgaaagaacgttaggcggttactcgctaacc

SEQ ID NO: 389601 - DNA, 535 bp, Homo sapiens
  misc_feature: GZ8MTXP01CATX9.13.59.F04.1.454.CMB.2.raw
  modified_base (201)..(201): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcaacgacattaacacttattagcctggtatcagcagaagccaggagagtaccctaaattattgatctctgctgcgtccgcttgcaacgtcgggggtccagtctcggttacaggtggcggtgggatcgtaggacagattcactctcacatacaccaacctgcacccagaacgagtgttagggtaagtttattactgtacagtacctatagtggtcggcccgtctctcgttttcgggcgggtaacgggaccgaaagggtgaccgagactaacgaaaaccgtaagtggttacgggcttggcctaacccg

SEQ ID NO: 389602 - DNA, 509 bp, Homo sapiens
  misc_feature: GZ8MTXP01CWMV9.13.59.F04.1.454.CMB.2.raw
  modified_base (215)..(215): a, c, t, g, unknown or other
  modified_base (226)..(226): a, c, t, g, unknown or other
  modified_base (295)..(295): a, c, t, g, unknown or other
  modified_base (459)..(459): a, c, t, g, unknown or other
  modified_base (482)..(482): a, c, t, g, unknown or other
  modified_base (497)..(497): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacactatttagcctggtatcagcagaagccaggagagtccctaaatattgaatctntgctgcgtccgcttgcaactcgggggtccatctcggttcagtggcgtggatctaggacagattcactctcaccataccacaacctgccaccctagaagtatgttagggggaatttattacctgttaccagacctagtagtggtgggccctcgtcaagtttcggnggtagggaccgaaagggtgacgnggataacaaagaacngtggctgcaacc

SEQ ID NO: 389603 - DNA, 571 bp, Homo sapiens
  misc_feature: GZ8MTXP01ECXTJ.13.59.F04.1.454.CMB.2.raw
  modified_base (207)..(207): a, c, t, g, unknown or other
  modified_base (216)..(216): a, c, t, g, unknown or other
  modified_base (238)..(238): a, c, t, g, unknown or other
  modified_base (274)..(274): a, c, t, g, unknown or other
  modified_base (288)..(288): a, c, t, g, unknown or other
  modified_base (296)..(296): a, c, t, g, unknown or other
  modified_base (350)..(350): a, c, t, g, unknown or other
  modified_base (386)..(386): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctctggagacagngtcaccgtnacgttggccgggcagtcacganattaacacttattagctgtatcagcagagcaggganacgtacctaaattntagatctntgctgcgtccgtctgcgtacggtccggggtcctatcgtcggttacgagggtggnggtggactacgtagactagtacttcactctacacanaccaaccactcgacaccgtagaagtattaggttaggggtaaatttacgttactgtacgacgtaaccttagttacggtcgggtacggtcccgtcgttcggttaacggtttcggggaacgggtacgggttaaccgaagggtcgacgagactaacgaaacgtaacgtgggtacgactcgaactaaccg

SEQ ID NO: 389604 - DNA, 513 bp, Homo sapiens
  misc_feature: GZ8MTXP01A8AM0.13.59.F04.1.454.CMB.2.raw
  modified_base (277)..(277): a, c, t, g, unknown or other
  modified_base (400)..(400): a, c, t, g, unknown or other
  modified_base (482)..(482): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttattagcctggtatcagcagaagccaggganagtaccctaaattattgatctctgctgcgtccgccttgcaacgtccgggggtccagtctcggtcaggtggcggtgggatcgtaggacagaattcactctcacatcaccaactgcaccctgaanatgttaggggaagttattactgtacagacctatagtggtcgccgctctaagtttcggcgggtacgggaccgaagggtgacgngactcaaacgtaactggtgggctggcaaccg

SEQ ID NO: 389605 - DNA, 518 bp, Homo sapiens
  misc_feature: GZ8MTXP01DR1KA.13.59.F04.1.454.CMB.2.raw
  modified_base (215)..(215): a, c, t, g, unknown or other
  modified_base (476)..(476): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttggccgggcagtcacgacattaacacttatttagcctggtatcagcagaagccagggagagtacccctaaattattgatctctgctgcgtccgccttgcaactcgggggtccatctcggttcagtggcggtggatctaggacagaattcactctcacatcaccaacctgcaccctgaagatgttagggaaagtttattactgtcagacctatagtggtcgccgtctcgtaattttcggcggtagggaccgaaagggtnacgagactaacgaaaacgtaacgtggtaggctcggcgtaacc

SEQ ID NO: 389606 - DNA, 503 bp, Homo sapiens
  misc_feature: GZ8MTXP01AXSAG.13.59.F04.1.454.CMB.2.raw
  modified_base (215)..(215): a, c, t, g, unknown or other
  modified_base (226)..(226): a, c, t, g, unknown or other
  modified_base (382)..(382): a, c, t, g, unknown or other
  modified_base (392)..(392): a, c, t, g, unknown or other
  modified_base (467)..(467): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacacttattagcctggtatcagcagaagccagggagagtccctaaattattgatctctgctgcgtccgcttgcaacgtcgggggtccagtctcggttcagtgcggtggatctaggacagaattcactctcacatcaccaactncaccctgaanatgttaggggaattattactgtcagcctatagtgtgccgtctcaattttcggcggaggaccgaaagggtgaccgnggataacaaccgaacgtagtgggctcggcgtaaccc

SEQ ID NO: 389607 - DNA, 518 bp, Homo sapiens
  misc_feature: GZ8MTXP01AVXIZ.13.59.F04.1.454.CMB.2.raw
  modified_base (226)..(226): a, c, t, g, unknown or other
  modified_base (368)..(368): a, c, t, g, unknown or other
  modified_base (373)..(373): a, c, t, g, unknown or other
  modified_base (380)..(380): a, c, t, g, unknown or other
  modified_base (388)..(388): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctctgctgcgtcgcttgcaacgtcgggggtccatctcggttcagtggcggtggatctaggacagaattcactcncacanacacacnacacaganatgtaggtagttattactagtcagtacgtagtagtcggtcggtccgtcgtcgtcgttcggttcgggtacgggacggtaacggtagacgacgacgtaacgaaacgtaacgtggtcggacgtcgcgtaaccg

SEQ ID NO: 389608 - DNA, 633 bp, Homo sapiens
  misc_feature: GZ8MTXP01BFXIV.13.59.F04.1.454.CMB.2.raw
  modified_base (200)..(200): a, c, t, g, unknown or other
  modified_base (214)..(214): a, c, t, g, unknown or other
  modified_base (226)..(226): a, c, t, g, unknown or other
  modified_base (275)..(275): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtnacgttgccgggnagtcacgacaattaacacttattagcctggtatcagcagaagcgagganacgtacctaaattatgatctctgctgccgtccgtccttgactaaccggtccgggggtcctagtccgtcggttacgaggtgggcggtggtatcgtaaggactagtaaacttcactcctaccacactaccaacccaacctcgacccaacccgttagaacgtagtttacggttaagggtaaacgtttagttacttacgtacgtaacgtaaccgttagtaacgggttcggtccgggtacccgtcgtttcggttaacggttttcccggggaacggggtaacggggttaacccgtaaagggttcgggaccttaagggactaaacgaaacgtaacgttgggtaggttccgtaacggccgtaaccg

SEQ ID NO: 389609 - DNA, 500 bp, Homo sapiens
  misc_feature: GZ8MTXP01CHRFF.13.59.F04.1.454.CMB.2.raw
  modified_base (227)..(227): a, c, t, g, unknown or other
  modified_base (388)..(388): a, c, t, g, unknown or other
  modified_base (458)..(458): a, c, t, g, unknown or other
  modified_base (492)..(492): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaaccgtcacttgccgggnagtcacgacattaacacttattagcctggtatcagcagaagccaggagagtacccctaaattattagatctactgctgcgttccgccttgcgaactcgggggtccagtcctcggttcagttggcgtggatctaggacagaatcactctcacatcacacctncacctgaagatgttagggggaattattactgttacagacctatagtggtgcccgtctctaatttcggcgngggaccgaaaggtgacaggatccaaagaactggngctcgctc

SEQ ID NO: 389610 - DNA, 626 bp, Homo sapiens
  misc_feature: GZ8MTXP01DHFB0.13.59.F04.1.454.CMB.2.raw
  modified_base (201)..(201): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggnagtcacgacattaacacttattagcctggtatcagcagagccaggagacgtacctaaattattgatctctgctgcgtccgccttgctaacgtcgggggtcctagtctcggttcaggtgggcggtgggatacgtaggacagtaacttcactctcaccatccaaccaaacctcgaccaccctagaaacgtagttggtttaaggggtaaagttttaactttaacgttagtacctaacgtaacccgttagttaaacggttcgggttaccgggtccccgtccgttcgtaaacggtttttcgggaccggggtaaacggggaacccgtaaaggggttcgaccgaaggttaacgttaaccgaaaaacggtaaccgttagggtacggaccgttcggaaccgtaacccg

SEQ ID NO: 389611 - DNA, 578 bp, Homo sapiens
  misc_feature: GZ8MTXP01CMHRG.13.59.F04.1.454.CMB.2.raw
  modified_base (201)..(201): a, c, t, g, unknown or other
  modified_base (215)..(215): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttggccgggnagtcacgacattaacacttattagctggtatcagcagaagccgaggagagtacctaaattatgatctctgtctgcgtccgcttgcgtaacgtccggggtcctagtcgtcggttacaggtggcgggtggagtcgtaggacagtattcactctacacactccaaccgaacctcgacctacccagtaagtattaggttagggtaaagtttattacctaggtcaagtacctagttaacggtcggtacggtccccgtcgttcgttaacggttttccgggacggggtacgggaccgtaaagggtcgacgagaacgtaacgaaaccgtaacgttggacggttctcgaaccgtaacccg

SEQ ID NO: 389612 - DNA, 648 bp, Homo sapiens
  misc_feature: GZ8MTXP01BBB7L.13.59.F04.1.454.CMB.2.raw
  modified_base (230)..(230): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtcctgcatctcttggagacagagtccaccgtcacgttggccgggnagtcaacgactattaacacttattagcctggtatcagcagaagccagggagagtacctaaattactgatctctgctgccgtccgccttgccgtaacgtccgggggtcctagtccgtcggttaccgagggttcgggccgggtaggtacgttaccgtaagggaacctaaggtaaactttaccaaccttactacctaacccaattacccgaaaccctaaacctcggaccaacccgttagaaacgtattagggtaggggttaaatttatttaaccgtgtactaacgtaccttagtacggtggtcgtcccgtcgtcctaacggttttcggggacgggtacgggaaccgtaacggggttaacgacgttacgttaacgtaacgtaaaccggtaacgttcggtacggttaccgtcgaaccgtaacg

SEQ ID NO: 389613 - DNA, 556 bp, Homo sapiens
  misc_feature: GZ8MTXP01AOLQV.13.59.F04.1.454.CMB.2.raw
  modified_base (227)..(227): a, c, t, g, unknown or other
  modified_base (393)..(393): a, c, t, g, unknown or other
  modified_base (400)..(400): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggnagtcacgacattaacacttatttagcctggtatcagcagaagccagggagagtaccctaaattattgatctctgctgcgtccgcttgctaacgtcgggggtccagtcctcggttcagttgggcggtggatcgtaggacagtaattcactctcacatcaccaacgtncaccctnaagatgttagggaagtttattactgtcagacctagtagtggtcggccctctcgtaagttttcgggcgggtacgggttaccgaaagggttcggacgttaagggacttaacgaaaacccggtaacgttcgggggtacgttaccgtcgaaccgtaaccg

SEQ ID NO: 389614 - DNA, 497 bp, Homo sapiens
  misc_feature: GZ8MTXP01DRQU7.13.59.F04.1.454.CMB.2.raw
  modified_base (213)..(213): a, c, t, g, unknown or other
  modified_base (225)..(225): a, c, t, g, unknown or other
  modified_base (253)..(253): a, c, t, g, unknown or other
  modified_base (258)..(258): a, c, t, g, unknown or other
  modified_base (269)..(269): a, c, t, g, unknown or other
  modified_base (279)..(279): a, c, t, g, unknown or other
  modified_base (282)..(282): a, c, t, g, unknown or other
  modified_base (284)..(284): a, c, t, g, unknown or other
  modified_base (286)..(286): a, c, t, g, unknown or other
  modified_base (476)..(476): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctggagacagagtcacgtnacgttgccgggnagcacactataactattatagctagtancaganagagcgagganactactaatntantntngctcgcgtctctgacgtacggtcggtctgtcgtcgtagaggtggcgtagacgtacgtagactagtactcactcacacactacaaccgtactcacacgagtagtagtagtaggtaagttagttacgtagtactacgtacgtagtagtcgtcgtcgtcgtcgtcgtcggacggacgacgagtgagagacaanaacgaacgtgtgcgtcgcgtc

SEQ ID NO: 389615 - DNA, 516 bp, Homo sapiens
  misc_feature: GZ8MTXP01B3PGU.13.59.F04.1.454.CMB.2.raw
  modified_base (226)..(226): a, c, t, g, unknown or other
  modified_base (386)..(386): a, c, t, g, unknown or other
  modified_base (506)..(506): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacactatttagcctggtatcagcagaagccagggagagtccctaaattattgatctctgctgcgtccgcttgcaactcgggggtccagtctcggttcagtggcggtggatcgtaggacagaaattcactctcacatcaaccaacctncaccctgaagatgttagggtaagtttagttactgtacagtacctataagtggtggcccgtctctaagttttcggcgggacgggttaccgaaagggtgcgaggataacaacgaacttgggngctcgcgaac

SEQ ID NO: 389616 - DNA, 590 bp, Homo sapiens
  misc_feature: GZ8MTXP01CAFNF.13.59.F04.1.454.CMB.2.raw
  modified_base (227)..(227): a, c, t, g, unknown or other
  modified_base (420)..(420): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctggagacagactcaccgtcacttggcccgggnagtcacgacattaactacttattagcctggtatcagacagaagccgagggagacgtacccgtaaattattgtatctctcgctcgccgttccgccttgccgtaaccgtccgggggtacctagtccgttcggttccgtaggtcgggtcgggtggatcgaggacagtaacttcactctcaccataccaaccgaacnctacaccctagtaagtattggttaggggtaaagtttattaactcgtacgacgtaccgttatacgggtcggtccggacccgtctcgttaacggtttcgggacggggacgggaaccgtaagggtcgacgagacgtaacgaaaacgtaacgttggtcgggctaacggctaacc

SEQ ID NO: 389617 - DNA, 493 bp, Homo sapiens
  misc_feature: GZ8MTXP01BE2PU.13.59.F04.1.454.CMB.2.raw
  modified_base (435)..(435): a, c, t, g, unknown or other
  modified_base (467)..(467): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacttgccgggcagtcacgacattaacacttatttagcctggtatcagcagaagccagggagagtccctaaattattgatctctgctgcgtcgccttgcaacgtcgggggtccatctcggttcagtggcggtgggatctagggacagaattcatctcacatcacacctgcacctgaagatgttggggaagttattactgtcagactatagtgtggcccgntcaattttcggcggtaggaccgaaaggtgcgngagtaacaaagaactgtgctgcaacc

SEQ ID NO: 389618 - DNA, 544 bp, Homo sapiens
  misc_feature: GZ8MTXP01BCZBO.13.59.F04.1.454.CMB.2.raw
  modified_base (226)..(226): a, c, t, g, unknown or other
  modified_base (370)..(370): a, c, t, g, unknown or other
tcagtcacgtactacacgaccggtgctcgatttagtacacacacttagggattgggggcagaagtctctctcagtcaggacacagcatggacatgagggtccctgctcagctcccgggactcctgctgctctggctcccagataccagatgtgacatccagatgacccagtctccatcctccctgtctgcatctcttggagacagagtcaccatcacttgccgggnaagtcaggcatagaatgataggctggtatcagcagaaaccagggaaacgcccctaagctctgatctatggtgcatacctaaggtttaaaagtcggggtacccccagtcaaggttcagcggcaagtgatctggctacagtacttnattctcacatcagcagcctgcagcctgaaggtattttgactaacgttatactgtactacagtatctaactaattaagtccgaggggtacgtttccgggaaccgtaaggggacccgttaaagggttacgggaaaattaccggaaaacgttaacggtggttacgtcgttcgtaacc

SEQ ID NO: 389619 - DNA, 550 bp, Homo sapiens
  misc_feature: GZ8MTXP01CA7W4.13.59.F04.1.454.CMB.2.raw
  modified_base (216)..(216): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtnacttgccgggnagtcacgacattaacacttattagcctggtatcagcagaagccagggagagtaccctaaattattgatctctgctgccgtccgccttgcgaacgtccgggggtccagtctcggttcaggtggcgggtggatcgtaggacagaattcactctacacatccaaccaacctgaccaccctagaaacgtagttaggttaggggtaaagtttatttactagtacagtacctagtagtggtcggcccgtctcgtaagtttcggcgggtacgggaccgtaaagggtgacgagactaacgaaacgtaacgtaggtgggctcgccgtaaccg

SEQ ID NO: 389620 - DNA, 534 bp, Homo sapiens
  misc_feature: GZ8MTXP01AK5A9.13.59.F04.1.454.CMB.2.raw
  modified_base (442)..(442): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttattagcctggtatcagcagaagccagggagagtccctaaattatgatctctgctgcgtccgccttgcaacgtcgggggtccatctcggttcaggtggcggtggatctaggacagaattcactctcacatcaccaactgcaccctgaacatgtagggaagttattactgttacagacctatagtggtcgccccgtntctaagttttcggacgggtacgggttacccgaaagggtgaccgttaggactaacaaaacggaaccgttggtcgggcttaaggccgtaacccg

SEQ ID NO: 389621 - DNA, 577 bp, Homo sapiens
  misc_feature: GZ8MTXP01A7XRF.13.59.F04.1.454.CMB.2.raw
  modified_base (202)..(202): a, c, t, g, unknown or other
  modified_base (228)..(228): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagatcaccgtcacgttggccgggnagtcacgacattaactacttattagcctggtatcagacagaacgcgaagggagacgtaccctaaattattgatctctgctcgcgtccgtcgttgcgtaacgtccggggtccagtcgtcggtcaggtggcggtggatcgtaaggacagtaactcactctacactactacaacccacctgacccaaccgtagaacgtagttggttaagggtaagttacttacgtgtacagtaccttagtagtcggtccgtacccgtcgttcgtaacggtttcggggacggggtaacgggaccgtaaagggtcgacgagttacgtaacgaaaacgtaacgtggtacgcttcggaacctaacc

SEQ ID NO: 389622 - DNA, 601 bp, Homo sapiens
  misc_feature: GZ8MTXP01A2SE7.13.59.F04.1.454.CMB.2.raw
  modified_base (173)..(173): a, c, t, g, unknown or other
  modified_base (202)..(202): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcnccatcctccctgtctgcatctcgttgganacagagtccaccgtcacgttcggccgggcagtacacgactattaacacttattagcctggtatcagcagagccagggagagtaccctaaattacttgatctctgctgcgtccgcttgctaacgtcggggccagtcctggtacagtggcggtgactcgtagacagaattcactctcacatccaccaacgtcaccaccgtagaacgtagttacggttaggggtaaagtttacgtttaacgtacgtttacgaacgttaacccgttaagttaacgggtcggggttccggcccggtccttacggttaacggttttcggggcgggtaaacggggccgtaaagggggttcacgaagacgtaaccgaaaacggtaacgttggtcgggactcggttaaccgtaacccg

SEQ ID NO: 389623 - DNA, 545 bp, Homo sapiens
  misc_feature: GZ8MTXP01BIX12.13.59.F04.1.454.CMB.2.raw
  modified_base (227)..(227): a, c, t, g, unknown or other
  modified_base (344)..(344): a, c, t, g, unknown or other
  modified_base (377)..(377): a, c, t, g, unknown or other
  modified_base (381)..(381): a, c, t, g, unknown or other
  modified_base (407)..(407): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggnagtcacgacattaacacttattagcctggtatcagcagaagccaggagagtccctaaattatgatctctgctgcgtccgcttgcaagtcgggggtccatcgtcgtcgagtggcgtgntctaggacagaattcatctcacatcacactgcnccanagatgtggggaatttagtactgtcanaccgttataaggttcggtcggccccggtctcgttaacgttttcgggaccgggtacggggacccgaaagggggttaacgacggttagaacgtaacgtaaacggtaacgtcgggtacggttacgtcgttaaccgtaaccg

SEQ ID NO: 389624 - DNA, 544 bp, Homo sapiens
  misc_feature: GZ8MTXP01B6DP0.13.59.F04.1.454.CMB.2.raw
  modified_base (203)..(203): a, c, t, g, unknown or other
tcagtcacgtactacacgaccggtgctcgatttagtacacacacttagggattgggggcagaagtctctctcagtcaggacacagcatggacatgagggtccctgctcagttcctgggactcctgctgctctggctcccagataccagatgtgacatccagatgacccagtcctccatccctccctgtctgcatctcttgganacagagtcacggtcacgttggccgggcgagtcacgacattaacacttattagcctggtatcagcagaagccgagggagagtccctaaattattgatctctgctgcgtccgcctgcaagtcccggggtccatcgtcggtcagtggcggtgatcgtaggacagattcactctcaccatccaacccaacctcgccaccctagaatagtagttaggtaaaggtttattacgtgtacgtagtacctagttaggtcggtcggtcccgtctcgtacgttttcgggcggttagggaccgaggtcgcgagacttacgtaaagacgtggtacggcttgccttaacgtaacg

SEQ ID NO: 389625 - DNA, 571 bp, Homo sapiens
  misc_feature: GZ8MTXP01EO6I8.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccatctccatccctccctgtcctgcattctcttggagacagagtccaccgtcacgttcggccggggtcgagtcacgaaccatttaaacacttatttagcctggtatcagcagaagccagggagagtccctaaattattgatcgttcagctgcgtcgctcggcaacgtccgggggtccatcgtcggttacagggtggcgggtgactcgtagtacgatactcactctacaacctacaccaaccccactcgacccaaccctagaaagtatgttaggggtacgttttatacgtcgatacgaccttagtacggtgtccggcccgttcgtccgttaaggtttccgggacggggtacggccgtaaagggtcacgagttacgtaacgaacgtaaccgtggtgcgtgctaaccg

SEQ ID NO: 389626 - DNA, 546 bp, Homo sapiens
  misc_feature: GZ8MTXP01DSNU1.13.59.F04.1.454.CMB.2.raw
  modified_base (201)..(201): a, c, t, g, unknown or other
  modified_base (215)..(215): a, c, t, g, unknown or other
  modified_base (225)..(225): a, c, t, g, unknown or other
  modified_base (399)..(399): a, c, t, g, unknown or other
  modified_base (412)..(412): a, c, t, g, unknown or other
  modified_base (465)..(465): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccggnagtcacgacattaacacttattagcctggtatcagcagaagccaggagagtaccctaaattactagatctctgctcgcgttccgccttgcctaacgtccgggggtcctagtcctcggttacgagtggcgggtggatcgtaggacagaattcactctacacataccaccaacctnaccaccctagaanagtagttggggtaaatttagttactgtcagacctagtacgtggtcggcccgtntctaagttttcgggcgggtacgggaccgtaaagggtgacgttagacgtaacgaaacgtaacgtggtggctggccgtaaccg

SEQ ID NO: 389627 - DNA, 644 bp, Homo sapiens
  misc_feature: GZ8MTXP01A8J1W.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggcgagtcaacgacattaacacttattagcctggtatcagcagaagcgaggagacgtacctaaattatgattctactcgtctcgccgtccgtcttcgaccgtaacggtccgggggtccagttcgtacggttcaggttgggcgggtggactcgtaggacagtaaacttcactctacacactaccaaccaacctcgacccacctagaagtagttacggttaggtaaacggtttatttaaccgtagttacgtaacggtaaccctttagttaacgggtcggttccgggtccccgtctttccggttaacggtttttcccgggggacggggtaaacgggttaacccggtaagggttcgaccggttaggaaccgttaacaaacccggggtaattcgggttcgggaccttcggaacccgttaacccg

SEQ ID NO: 389628 - DNA, 517 bp, Homo sapiens
  misc_feature: GZ8MTXP01BB3KS.13.59.F04.1.454.CMB.2.raw
  modified_base (215)..(215): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacacttattagcctggtatcagcagaagccagggagagtccctaaattattgatctctgctgcgtccgctgcaacgtcggggtccagtctcgttcagtggcggtgatctaggacagaatcactctcacatcaccaactgccacctgaacgatcgttagggggtaatttagttactgtacagtacctagtagtggtcggcccgctctaagtttcggacgggtacggacccgaagggtcgcgaggactaacgaaacgaacgtgtgcgtaaccgcgtaacg

SEQ ID NO: 389629 - DNA, 550 bp, Homo sapiens
  misc_feature: GZ8MTXP01DJYRX.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggcacccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaatcgggggtccatctcggtcagtggcggtgatctaggacagaattcactctcacatcaccaactgcaccctgaagatgttaggggaagtttattacctgtcagtacctagtagtggtcggcccgtcgtctaacgttttcgggacggggtacgggacccgtaaagggttcgaccgttaggaacttaaccgaaaaacggtaaaccgttggttacggggacttcggaaccgtaacccg

SEQ ID NO: 389630 - DNA, 542 bp, Homo sapiens
  misc_feature: GZ8MTXP01DLAN0.13.59.F04.1.454.CMB.2.raw
  modified_base (201)..(201): a, c, t, g, unknown or other
  modified_base (389)..(389): a, c, t, g, unknown or other
  modified_base (410)..(410): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagagcagggagagtccctaaattatgatctctgctgcgtccgccttgcaacgtccgggggtccatcgtcgttcagtggcggtggatcgtagacagaattcactctcacatcacaactgcacctgaanatgttgggaagtttattactntcaagacctagtagtggttcgcccgtacttcgtaacgttttcgggacggggtaacgggaacccgtaaagggtcgttaccgaggttaactaaccgaaaaacgtaaccgtggttacggctcggaacctaacccg

SEQ ID NO: 389631 - DNA, 611 bp, Homo sapiens
  misc_feature: GZ8MTXP01CW6EN.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacttgccgggngagtcacgacattaacacttattagcctggtatcagcagaagccagggagagtacctaaattattgatctctgctgcgtccgccttgccgtaacgtccgggggtcctagtccgtcgggttacgagggtgggtcgggtgggtagtcgtaagggacaggtaaacttcctactcctacaccaattacccaaccctaaccctgacccaaccccgttagaaagtattaggtttaggggttaaagtttaatttacgtaggttaccacgtaaccgttagttacggtcgggtcggcccgtcttcgtaacgttttcgggcggggacgggaccgtaaagggtcgacgaggttactaaccgaaaacgtaacgtggttcgggacttcgcgtaaccg

SEQ ID NO: 389632 - DNA, 540 bp, Homo sapiens
  misc_feature: GZ8MTXP01BL7LR.13.59.F04.1.454.CMB.2.raw
  modified_base (215)..(215): a, c, t, g, unknown or other
  modified_base (506)..(506): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcgagtcacgacattaacacttattagcctggtatcagcagaagccgagggagacgtaccctaaattattgatctctgctgcgtcgcctgcaacgtccgggggtccagtcgtcggttcaggtggcggtggatcgtaggacagaattcactctcaccatccaacctaaccctgacccaccctagaacgtattggttaggggtaagtttattactgtacagtaccgtagtagtggtcggcccgtctcgtaacgttttcgggacgggtacggggaccgaagggtnacgagataacaaacgaactggtagctgctaaccg

SEQ ID NO: 389633 - DNA, 591 bp, Homo sapiens
  misc_feature: GZ8MTXP01CMADG.13.59.F04.1.454.CMB.2.raw
  modified_base (356)..(356): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagacgtcaccgtcacttggccgggcagtcacgacattaacacttattagcctggtatcagcagaacgaccgaggagacgtaccctaaattattgatctctgctgccgtccgcttgcaacgtccggggtccagtctcggtcaggtggcggtgntcgtaggactagattcactctcaccactccaacctaacctgacctacccgtagaacgtagttaggttacggggtaagtttacgtttactcgtacaacgtaacccgttagttacggtcggtcgggccccgtcgttccgtaaggttttccggggacgggtaacggggacccgtaagggtcgaccgagttaacgtaacgaaaacgtaacgtagggtcggaccgttcggccgtaacccg

SEQ ID NO: 389634 - DNA, 572 bp, Homo sapiens
  misc_feature: GZ8MTXP01BGISE.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggnagtcacgacataacacttattagcctggtatcagcagagccaggagagtaccctaaattattgatctctgctgcgtcgctgcaacgtcggggtccagtctcgtcagtggcgtgatcgtaggacagtaatcactctacacactccaacctaacctcgaccacccgtagaagtagttaggttagggtaaagtttagttacctgtactacgtaccgttagtaacggttcggtccggtcccgtcgttcgtaacggttttcgggacggggtacggacccgaaagggttgaccgttagacgttaaccgaaaacccgtcgtttaagggtacggacttcggttccgtaacccg

SEQ ID NO: 389635 - DNA, 593 bp, Homo sapiens
  misc_feature: GZ8MTXP01ESAQC.13.59.F04.1.454.CMB.2.raw
  modified_base (215)..(215): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacacttattagcctggtatcagcagaagccgagggagacgtaccctaaattattgattctctgctgcgtccgcttgcgacgtcggggtccatctcggttcaggtggcggtggatcgtaggacagtaacttcactctcacactcaaccaacctgaccaccctagaaagtagttaggttaggggtaaagtttacgtttaacgtacggtactaagtacccgttaagttagggttcgggtccggtcccgtccgttcgtaacggtttttccggggacgggtaacggggaaccgtaaagggtcgacgttagaaccgtaacgaaaacggtaaccgtggtacggttcttcggaacctaaccg

SEQ ID NO: 389636 - DNA, 504 bp, Homo sapiens
  misc_feature: GZ8MTXP01D87N8.13.59.F04.1.454.CMB.2.raw
  modified_base (200)..(200): a, c, t, g, unknown or other
  modified_base (227)..(227): a, c, t, g, unknown or other
  modified_base (274)..(274): a, c, t, g, unknown or other
  modified_base (288)..(288): a, c, t, g, unknown or other
  modified_base (400)..(400): a, c, t, g, unknown or other
  modified_base (452)..(452): a, c, t, g, unknown or other
  modified_base (474)..(474): a, c, t, g, unknown or other
  modified_base (478)..(478): a, c, t, g, unknown or other
  modified_base (490)..(490): a, c, t, g, unknown or other
  modified_base (496)..(496): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctcctgtctgcatctctgganacagagtcaccgtcacgttggccgggnagtcacgacattaacacttattagcctggtatcagcagaagcagganacgtacctaaattnttgatctctgctgcgtccgcttgctaacgtcggggtccagtctcggtacagtggcggtgactacgtaggacagtactcactctacacactacaacccgaactcgactaccgngaagtattgttaggtaagtttattactgtacagctagtacgtgtcgcctctntgtttcggaggacggacaggtnacgngataacaaacgngtaggngctcgctc

SEQ ID NO: 389637 - DNA, 619 bp, Homo sapiens
  misc_feature: GZ8MTXP01B2J70.13.59.F04.1.454.CMB.2.raw
  modified_base (216)..(216): a, c, t, g, unknown or other
  modified_base (229)..(229): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtcctgcatctcttggagacagagtcaccgtnacgttggccgggnagtcaacgacattaacacttattaagcctggtatcagacagaagccgagggaagagtaccctaaattattgaatctctgtctcgccgtcccgtcttcgcgtaaccgttccgggggtccacgtcgtccggttacgaggtggcgggtaggatacgtaggacagtaacttcactctacacctaactccaaccctaacctcgtaccacccgtagaaacgtaagttaggttagggggtaaattttaacgttacgttacggtactaacgtaaccgttaagttaacggtcgggtccggtcccgtctcgttaacggtttcgggaccggggtaagggaccgtaaagggtcgaccgaagacgtaacgaaacgtaacgtggtcggactcggaacgtaaccg

SEQ ID NO: 389638 - DNA, 575 bp, Homo sapiens
  misc_feature: GZ8MTXP01DTZ4Y.13.59.F04.1.454.CMB.2.raw
  modified_base (202)..(202): a, c, t, g, unknown or other
  modified_base (229)..(229): a, c, t, g, unknown or other
  modified_base (300)..(300): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttgganacagagtcaccgtcacgttggccgggnagtcaacgacattaacacttattagcctggtatcagcagaagccagggagagtacctaaattattgatctntgctgcgtccgcttgactaacgtccgggggtaccagtccgtcggttcaggtgggcgggtggatacgtagggacagtaacttcactctacacactacaacccaactcgaccaccctagaaagtattaggttaggggtaaatttagttaaccgtgtacacgtactagtacggtggtcgcccgtctcgttaagtttcgggacgggtaagggttacccgaaagggttcgacgagttaacgtaacccgaaaagaacgttggcggttctaaggccgtaacc

SEQ ID NO: 389639 - DNA, 585 bp, Homo sapiens
  misc_feature: GZ8MTXP01AX7UY.13.59.F04.1.454.CMB.2.raw
  modified_base (215)..(215): a, c, t, g, unknown or other
  modified_base (226)..(226): a, c, t, g, unknown or other
  modified_base (276)..(276): a, c, t, g, unknown or other
  modified_base (326)..(326): a, c, t, g, unknown or other
  modified_base (337)..(337): a, c, t, g, unknown or other
  modified_base (401)..(401): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctgactcccagataccagatgtgacatccagatgacccagtctccatcctccctgactgcatctcttggagacagagtcaccgtnacttgccgggnagtcacgacattaacacttatttagcctggtatcagcagaagccaggganagtccctaaattattgatctctgctgctcgcttgcaagtcgggacgtctntcgtcgtacgnggtcgggtcgggtgtactaggtagacgtaatactactacttcacacctactacccaacctaccncacctacgaagtagtagttaggggttaagttaagttacgttacgtacgtacgtacgtacgttacggttacgggtcggtcccgtccgtcgttaacggttcgggttaccggggtacgggacggtaacggtaggacgacgttaacgtaacgtaaacgtaacgtacgtcggttacgtcgaacgtaacg

SEQ ID NO: 389640 - DNA, 487 bp, Homo sapiens
  misc_feature: GZ8MTXP01EZLBW.13.59.F04.1.454.CMB.2.raw
  modified_base (226)..(226): a, c, t, g, unknown or other
  modified_base (431)..(431): a, c, t, g, unknown or other
  modified_base (441)..(441): a, c, t, g, unknown or other
  modified_base (458)..(458): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtccctaaattatgatctctgctgcgtccgccttgcaactcgggggtccatctcggtcagtgcggtgatcgtagacagaattcatctcacatcaccaactcgcaccctgaagatgttagggaagttataactgtacagactatagtgtgccgctntaatttcggnggagggaccaagggtgngagataacaacgaactggtggctgcaacc

SEQ ID NO: 389641 - DNA, 612 bp, Homo sapiens
  misc_feature: GZ8MTXP01D4OMV.13.59.F04.1.454.CMB.2.raw
  modified_base (216)..(216): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgctatctctggagacagactcaccgtnacgttggccggcgagtcacgactaattaactacttattacgcctggtatcagacagaacgcgaggagacgtacctaaattatgatctcgtgtctcgcgtccgtcgtgacgtaaccggtccggggtacctacgtccgttcggttacgagggtcgggcggtaggtactacgtaggactagtactcactcacacacacaccactcacaccgagaagtagttacggttaggggttaatttacgttactacgtacgaacgtacgtaagttacggtcggtccggtcccgtcgttacgttaacgggtttcgggacgggttaacggaaccggtaaggtcgaacgacggttaaacgaaccgtaaacgtaaccgtgggttaccgacggtaaccgaaccgtaacccg

SEQ ID NO: 389642 - DNA, 571 bp, Homo sapiens
  misc_feature: GZ8MTXP01EOW1H.13.59.F04.1.454.CMB.2.raw
  modified_base (280)..(280): a, c, t, g, unknown or other
  modified_base (294)..(294): a, c, t, g, unknown or other
  modified_base (302)..(302): a, c, t, g, unknown or other
  modified_base (314)..(314): a, c, t, g, unknown or other
  modified_base (528)..(528): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccatctccatccctccctgttcctgcatctcttggagacagacgtccaccgtcacgttggccgggcgagtcacgacattaacacttattagcctggtatcagcagagcgagganacgtacctaaattntgatctcngtctcgccgtcnctcggacctaacggtccgggggtcctagtcgtcggttacagggtggtcgggtggattcggagtacgataacttcaactctacacactaccgaaccccacgtcaccctaccgagtaagtgttgttaaggggtctttaagttctgactacgtacgttagtacggtcggtccgtccgtcgtacgttcggtttcgggacgggaccggttgaacgggtnacgagaccgtaacgagtaacgtcggcgttacgtcgaactaacg

SEQ ID NO: 389643 - DNA, 625 bp, Homo sapiens
  misc_feature: GZ8MTXP01DFECG.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtccaccgtcacgttcggccgggcagtccaacgactattaactacttattagcctggtatcagcaagaacgccgagggagacgtaccctaaattatagtactctctgcgtcgtccgtccgtccttgacgtaaccgtccgggggtcctagtcgtcggttacgaggtgggcgggtggtacgttcgtaaggactacgtaacttctactctacacctactaccaaccctaacctcgacctaacccgtagaacgtagttacggttaggggtaaacgtttaagttactacgtactaacgtaccttaagtacggtcgggtccggtcccgtcgttcgtaacggtttcgggacgggtaacgggacgtaaacgggtgacgttagaacgtaacgaaaacggtaacgttggtacggctcgccgtaacccg

SEQ ID NO: 389644 - DNA, 613 bp, Homo sapiens
  misc_feature: GZ8MTXP01DIN2C.13.59.F04.1.454.CMB.2.raw
  modified_base (202)..(202): a, c, t, g, unknown or other
  modified_base (230)..(230): a, c, t, g, unknown or other
  modified_base (292)..(292): a, c, t, g, unknown or other
  modified_base (301)..(301): a, c, t, g, unknown or other
  modified_base (566)..(566): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagacgtcaccgtcacgttggccgggnagtcaacgacattaacacttattagcctggtatcagcagagccgaggagagtacctaaattnttagatctntgctgtccgtccgtcttgaccgtaacggtccgggggtccagttccgtcggttacgaggtgggcgggtggagttcgtaaggacagaacttccaacttcctacaaccactaccaaccctaaccttcgacccacccgttagaaagtagttaggtttaggggtaaacgtttactttaactcgtacgtagtaaccgttagtacggttcgggtcggtcccgtcttcgttaacgttttcggggacgggtaacgggacgtaaacggtgaacgngttaacgtaaccgaaaacgtcgtagggtcgacgttcgaacgttaacc

SEQ ID NO: 389645 - DNA, 562 bp, Homo sapiens
  misc_feature: GZ8MTXP01DZ4VO.13.59.F04.1.454.CMB.2.raw
  modified_base (228)..(228): a, c, t, g, unknown or other
  modified_base (489)..(489): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtcctgcatctcttggagacagagtcaccgtcacgttgccgggnagtcacgacattaacacttattagcctggtatcagcagaagccagggagaccgtacctaaattacttagatctctgctgcgtccgcttgctaacgtccgggggtcctagtccgtcggtcaggtgggcggtgactctaggacagaattcactctcacataccaaccacctcgaccacccttagaagtagttagttaggggtaacgtttaattactgtacacgtaccttataggtcgtcggtccgcttcgtaagtttccgggngggacgggttaccgaagggtcgacgagttactaacgaaaacccggaagttgggtcggacgttcgcgtaacccg

SEQ ID NO: 389646 - DNA, 589 bp, Homo sapiens
  misc_feature: GZ8MTXP01DBI1I.13.59.F04.1.454.CMB.2.raw
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatccctccctgtctgcatctcttggatacagagtcaccgtcacgttggccgggcagtcacgacattaacacttattagcctggtatcagcagaagccagggagagtaccctaaattattgatctctgctgcgtccgcttgcaacgtcggggtccagtctcggtcaggtggcggtgatcgaggacagtaaactcactctacacactacaaccaaacctgaccaccgtagaagtagttaggttaggggtaaaggtttacttacttaggtacaagtccttaagtaacggtggtcggtcccgtcttccgttaaggttttccgggacgggtaacgggacccgtaaagggttcgaccgttaagttacgttaaccgaaaaacgtaaccgtaagggtcggttacgttcggccgtaaacccg

SEQ ID NO: 389647 - DNA, 648 bp, Homo sapiens
  misc_feature: GZ8MTXP01CBKSL.13.59.F04.1.454.CMB.2.raw
  modified_base (217)..(217): a, c, t, g, unknown or other
  modified_base (231)..(231): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagacgtcaccgtnacgttggccgggtnagtcacgacattaacacttattagcctaggtatcagcagaagcgaggagagtccctaaattattagatcgtctgctcgcgtccgtaccttgcgtaaccgtccgggggtacctagtccgtcggttccgaggtgggtccgggtgggacgttcgtagggactaaggtaaacttccaacttccttacacccaacttcccgaacccaacccttcgaccaaccccgttagaagtaagttggtttaacgggggtaaagttttactttaaacgtcgttacgtaacggtaaccctttagttaagggttcgggtccgtcccgtaccgttcgtaaacggttttccgggacggggttaacgggaccgttaaagggtcgaccgaggttactaacgaaacgtaacgtaggttcgcgtcgaaccgtaacccg

SEQ ID NO: 389648 - DNA, 626 bp, Homo sapiens
  misc_feature: GZ8MTXP01AUU6G.13.59.F04.1.454.CMB.2.raw
  modified_base (202)..(202): a, c, t, g, unknown or other
  modified_base (280)..(280): a, c, t, g, unknown or other
  modified_base (301)..(301): a, c, t, g, unknown or other
  modified_base (382)..(382): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtccaccgtcacttggccgggcgagtcacgacattaacacttattacgcctggtatcagcagaagccaggganacgtacctaaattatgatctntgctgcgtcgtctgcgtaacgtccggggtctagtctcggttcaggtggcggtgatcgaggacagtatcactctacactacncacccaactcgaccaccgttagaaacgtgttagttagggggtaaactttacgtttacgtacgttacgtaagtaacccgttaggttaacggttcggggttccggtccccggttaaccgttccggttaaacgggtttttcccggggaacgggggttaaccggacccggttaaagggtcgaccgttagacgttaaacgaaaaccgggtaacttcgggtacttacctttaacccgaacgtttaacccg

SEQ ID NO: 389649 - DNA, 517 bp, Homo sapiens
  misc_feature: GZ8MTXP01E4ALO.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtacccctaaattattgatctctgctgcgtccgccttgcaacgtcgggggtccatctcggtcagtggcggtgatctaggacagaatcactctcacatcaccactgcacctgaagatgttaggggtaagttattactgtcagacctagtaggtggtcggcccgcttctaagttttcgggcgggtacgggacccgaaagggtcgacgaggactaacaaaacgaactggtggctcgctaaccc

SEQ ID NO: 389650 - DNA, 584 bp, Homo sapiens
  misc_feature: GZ8MTXP01CT9NP.13.59.F04.1.454.CMB.2.raw
  modified_base (227)..(227): a, c, t, g, unknown or other
  modified_base (383)..(383): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttgccgggnagtcacgacattaacacttattagcctggtatcagcagaagccgagggagagtaccctaaattattgatctctgctgccgtccgccttgctaacgtccgggggtccagtcctcggttacaggttggcgggtggatcgtaggacagaaattcactcncaccatccaaccaacctcgacaccccttgaacgtattaggttagggttaaggtttaactttacgtagtactaacgtaccgttagttacggtgggtcggccccgtcttcgtaacgttttcgggacgggtacgggaccgtaaggggtcacgttacgaacgtaacgaaaacgtaaccgttaggtcggacggtcaaccgtaaccg

SEQ ID NO: 389651 - DNA, 564 bp, Homo sapiens
  misc_feature: GZ8MTXP01EE2ES.13.59.F04.1.454.CMB.2.raw
  modified_base (286)..(286): a, c, t, g, unknown or other
  modified_base (294)..(294): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtcacgttgccgggcagtcacgacattaacacttattagcctggtatcagcagagcgaggagagtacctaaattntgatcgtntgctgccgtccgcttgacgtaacgtccgggggtccagtcgtcggttccaggtggcggtggatcgtaggacagtacttcactctacactataccaacccgtacctcgaccaccgtagaatagttaggttacggggttaatttagttacgtgttacaacgtaccgttagtacggtcgggtccgcccgtcttccggttaagtttcgggacgggacggaccgtaaggtgacgaggttaataaccgtaaacgaacgttggaggctcgcgtaaccc

SEQ ID NO: 389652 - DNA, 607 bp, Homo sapiens
  misc_feature: GZ8MTXP01A1R2C.13.59.F04.1.454.CMB.2.raw
  modified_base (202)..(202): a, c, t, g, unknown or other
  modified_base (229)..(229): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtcacgttggccgggnagtcaacgactattaactacttattacgcctggtatcagcagaagccgaggagacgtacctaaattatgatctctgctcgtccgtccgtcgttcgacgtaaccggtccgggggtccagtccgtcggttcgaggtcgggcgggtgagtacgtaggacagtacttcactcctacacctactaccaacctacctcgaccacctagaacgtagttggtagggttaagtttattaacgtgtactagtaccgttagtaggtcggtaccggccgtcgttcgttaacggtttcggggacgggtaacgggaaccgtaaagggtcgaacgttacggttactaaacgaaaccgtaagtacgggtcggaccgttcggaacccgttaaccg

SEQ ID NO: 389653 - DNA, 612 bp, Homo sapiens
  misc_feature: GZ8MTXP01A6R86.13.59.F04.1.454.CMB.2.raw
  modified_base (200)..(200): a, c, t, g, unknown or other
  modified_base (227)..(227): a, c, t, g, unknown or other
  modified_base (296)..(296): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctgganacagagtcaccgtcacgttggccgggnagtcacgacattaacacttattagcctggtatcagcagaagccgaggagagtacctaaattatgatctntgctgcgtccgccttgacgtaacgtccgggggtcctagtccgtcggttacctaggtcgggcgggtgggtagtcgtaggacagtaattcactctacaccatccaaccaacctgaccaacccgtagaaacgtagttaggttacggggtaaaggtttaacttaccgtacgtacgtaacgtaaccgttaaggtaacggttcgggttccgggccccgttacgtcgttaacggttttccggggacgggttaacgggaaccgtaagggtcgaccgaggttactaacgaaacgtaacgttggcggttactcggaaccgtaaccg

SEQ ID NO: 389654 - DNA, 536 bp, Homo sapiens
  misc_feature: GZ8MTXP01A7EA7.13.59.F04.1.454.CMB.2.raw
  modified_base (228)..(228): a, c, t, g, unknown or other
  modified_base (337)..(337): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacgttgccgggnagtcacgacattaacacttattagcctggtatcagcagaagcaggagacgtacctaaattatgatctctgctgctccgcttgctacgtcggggtcatcgtcgtcagtgnggtgatctagacagatcactctacacatccaccaacctcgaccaccctagaagagttcgttaggtaagttatttacgtgtacagtacctagtaggtggtccggtcccgtcttcgtaacgttttccgggacgggtacgggaccgtaaagggtcgacgaggactaacgaaaacggtaaccttggtacgcgtcgcgtaaccc

SEQ ID NO: 389655 - DNA, 608 bp, Homo sapiens
  misc_feature: GZ8MTXP01AKYEU.13.59.F04.1.454.CMB.2.raw
  modified_base (285)..(285): a, c, t, g, unknown or other
  modified_base (360)..(360): a, c, t, g, unknown or other
  modified_base (366)..(366): a, c, t, g, unknown or other
tcagtcacgtactacacgaccggtgctcgatttagtacacacacttagggattgggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaatagaagtacagtgtgtangagttggattcgtcagtccccagggaagcccctggagtggcttgcacgcattgattgggatgatgatacaaaatntacaanaacatctatgaaagaccaggctcaccatctaccaaggacatcttacacgtagaccaaagtcggtaccttaagaaacgttcggaaccctaacgtttcggaccccttggtacggacacgacggacctaccttaatttacgttgtaacgcacaacttacgaaaagtacgttactttcttaaccgttaacgggtggttcgggtaaccggtcggttacgggggaacccgttaacgggggttccccgg

SEQ ID NO: 389656 - DNA, 583 bp, Homo sapiens
  misc_feature: GZ8MTXP01CBIZG.13.59.F04.1.454.CMB.2.raw
  modified_base (230)..(230): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtccaccgtcacgttggccgggnagtcaacgacattaactacttattagcctggtatcagacagaagccgagggagacgtaccctaaattatgtatctctgctgccgtccgtctcgcgtaaccgtccgggggtcctacgtctcggttacgtacggtgggcggtggtactacgtaggacgtaagtacttcactctacaccactaccaaccacgtcacctaccgagaagtagtaggttaggggttaagtttagttaactcgtacacgtaccgtagttacggtcggtccgcccgtcttcgtaacggtttcggacgggtacggaccgtaaaggtcgacgagaacgtaacgaaacgtaacgtgacgcgtaacgcgtaaccg

SEQ ID NO: 389657 - DNA, 592 bp, Homo sapiens
  misc_feature: GZ8MTXP01C5SS0.13.59.F04.1.454.CMB.2.raw
  modified_base (233)..(233): a, c, t, g, unknown or other
  modified_base (303)..(303): a, c, t, g, unknown or other
  modified_base (488)..(488): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcgttggagacagtacgtcaccgtcacgttcggccggngacgtcaacgactattaactacttattacgcctgtatcagcgaagagcgtagggatacgtacctaaattntgatctctgcgtgccgtccgtcttgcgtaccggtcggggtcctagtcgtcggtcgagggtcggtcggtgtacgtcgtaaggactagtaacttcactcaccactactacccgaaccctaactcgaccacgtagtaagtattaggtaggggtaatttatacgtagacgtaacgtacgtaggttcggnggtcccggtaccctcgtacggttaacggtttcgggcgggtacggaacgtaaggtcgaaccgttaggacaaccggaagtaacgtgggcgttctaacgcgttaacc

SEQ ID NO: 389658 - DNA, 605 bp, Homo sapiens
  misc_feature: GZ8MTXP01CJU8F.13.59.F04.1.454.CMB.2.raw
  modified_base (203)..(203): a, c, t, g, unknown or other
  modified_base (232)..(232): a, c, t, g, unknown or other
  modified_base (375)..(375): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcgttggaanacagagtccaccgtcacgttggcccgggnagtcaacgacattaactacttattagcctgtatcagcagaagccgagggagacgtacctaaaattacttgatctctgtctcgccgtccgtccttcgcgtaaaccggtccgggggtacctagtcgttcggttacgaggtcgggnggtcggtagtcgtaggactagaacttctactctacacctaactaccaacctaaacctcgacctacccagaagtagttaggttacgggtaagtttaacttacgtgtactacgtaccttagtacggtcggtcgcccgtcgttcgttaaggttttcggggacgggtacggacccggtaaaggtgacgagttaacgtaacaaacggtaacgtgtaggcttaacgccgttaaccg

SEQ ID NO: 389659 - DNA, 506 bp, Homo sapiens
  misc_feature: GZ8MTXP01DVKAQ.13.59.F04.1.454.CMB.2.raw
  modified_base (226)..(226): a, c, t, g, unknown or other
  modified_base (442)..(442): a, c, t, g, unknown or other
  modified_base (477)..(477): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtaccctaaattattagatctctgctgcgtccgcttgcaacgtcgggggtccatctcggttcagtggcgtggatctaggacagaaatcactctcacatacaaccaacctgcaccctagaatatgttagggaagtttatactgtcagacctatagtggtcgcccgtntcgtaatttcggcgggtagggaccaaaggtgacgngataacgaaaacaattgaggctgctaacc

SEQ ID NO: 389660 - DNA, 539 bp, Homo sapiens
  misc_feature: GZ8MTXP01BPHWN.13.59.F04.1.454.CMB.2.raw
  modified_base (201)..(201): a, c, t, g, unknown or other
  modified_base (215)..(215): a, c, t, g, unknown or other
  modified_base (228)..(228): a, c, t, g, unknown or other
  modified_base (277)..(277): a, c, t, g, unknown or other
  modified_base (502)..(502): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttggccgggnagtcacgacattaacacttattagcctggtatcagcagaagccgagganacgtaccctaaattattagatctctgctgcgtccgcttgcgaacgtccggggtaccagtcgtcggtcagtgggcggtggatcgtagacagtaattcaactctacactatccaaccaactcgccaccttagaatagtaggttaggggtaatttagttacctaggtacacgtacctagtaggtcgtcggcctctcgttaagtttcgggacgggtacggaccgtaggngacgaggactaacgaacgtaacgtgtggctgctaacg

SEQ ID NO: 389661 - DNA, 513 bp, Homo sapiens
  misc_feature: GZ8MTXP01EKMUW.13.59.F04.1.454.CMB.2.raw
  modified_base (399)..(399): a, c, t, g, unknown or other
  modified_base (481)..(481): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtaccctaaattattagatctctgtctgcgtccgccttgcaacgtccgggggtccagtctcggttcaggtggcggtggatcgtaggacagtatcactctcacatcaccaactgccacctgaanataggttaggtagttattactgtacagactatagtggtcggcccgtctcgtaagtttcgggcgggacggttacgaaggtcgngacgataacgaacgaactgaggctcgctaacg

SEQ ID NO: 389662 - DNA, 589 bp, Homo sapiens
  misc_feature: GZ8MTXP01DZW0Q.13.59.F04.1.454.CMB.2.raw
  modified_base (217)..(217): a, c, t, g, unknown or other
  modified_base (279)..(279): a, c, t, g, unknown or other
  modified_base (383)..(383): a, c, t, g, unknown or other
  modified_base (399)..(399): a, c, t, g, unknown or other
  modified_base (405)..(405): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctccctgtctgcatctcttggagacagagtcaccgtnacgttgccgggcagtcaacgacattaaacacttattagcctggtatcagcagaagcaggganagtacctaaattattgatctctgcttcgcgtccgcttgactaacgtccgggggtcctagtctcggttcacggtggcggtgggatctagggacagacttcactcncacatcaaccacgtcncacctnaagatagttggggtaaattattacctagtacgtaacgaaccttagttaacggttggtcggggtccccgtctcgttaacgttttcccggggagggggaacgggttaaccgaaacgggttcggacgaagggaaacgttaaccaaaaccggtaaacgtcggttagggcccgttaacgaaccgtaacc

SEQ ID NO: 389663 - DNA, 590 bp, Homo sapiens
  misc_feature: GZ8MTXP01AMGR1.13.59.F04.1.454.CMB.2.raw
tcagtcacgtactacacgaccggtgctcgatttagtacacacacttagggattgggggcagaagtctctctcagtcaggacacagcatggacatgagggtccctgctcatctcctgggactcctgctgctctggctcccagataccagatgtgacatccagatgacccagtctccatcctccctgtctgcatctcttggagacagagtccaccgtcacttggccgggcagtcacgacattaacacttattacgcctggtatcagcagagccgaggagacgtacctaaattatgatctctgctgcgtccgcttgctaacgtccgggggtccagtcgtcggttcaggtggcggtggatcgtaggacagtacttcactctcaccatacacccaactcgaccacccgttgaaacgtgttacggttaaggggtaaagtttactttaacttcggttaccaagtaccctagtacggtgggtcgcccgtctcgtaacgtttccggggacggttaacgggacccgtaaagggttcggaccgttaaggttactaaccggtaaacggaaccgttgggtcggacgtcgggaaccctaacccg

SEQ ID NO: 389664 - DNA, 630 bp, Homo sapiens
  misc_feature: GZ8MTXP01C9KBI.13.59.F04.1.454.CMB.2.raw
  modified_base (201)..(201): a, c, t, g, unknown or other
  modified_base (228)..(228): a, c, t, g, unknown or other
  modified_base (316)..(316): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatcctccctgtctgcatctctgganacagagtcaccgtcacgttggccgggnagtccaacgactattaaacactttaattagcctggtatcaagcagaagcgaggagacgtaccctaaattatgatctctgctgcgtccncttgcgaacgtccggggtcagtctcgtcgagtggcgtgactcgtaaggactagtaaacttcacttcctacacctacttacccaaacccgaacctcacctaacccgtaggaaagtagttaggtttaaggggtaaagttttatttaacctggttaaccaacggtaccttaggtttaacggtggtccgggcccttcgtacgttaacggttttacggggacgggtaaagggttacccgtaaagggtcgttaaccgaagttaaacggttaaccaaaaaccggtcgttgggaccgggttcttaacggaacccgttaaccg

SEQ ID NO: 389665 - DNA, 667 bp, Homo sapiens
  misc_feature: GZ8MTXP01BHXWD.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctggagacagatccacgtcacttggccgggcagtcacgactattaacacttattagcctggtatcagacagaacgaccgaggagacgtaccctaaattacttgatctctgctcgcgtccgcttgcgtaaccggtccgggggtcctacgtccgttcggttacacgggtgggtcgggtggtacgtcgtaaggacgtaagtaacttacacttacctacaacctactacccaacccctaacctacgtaccaccttagaagtagttaggtttaaggggttaagtttaagttacgtacgtacgtaacggtaccgttaggttaacggtcgggtccggtacccgtacgttccggttaacggttttccggggacggggtaaacggggttaacccggaaaggggttcgaaccggagttaaacgttaaccggaaaaccggtaacgtttacgggacggttaccgtaacggttaacccgtaacccg

SEQ ID NO: 389666 - DNA, 529 bp, Homo sapiens
  misc_feature: GZ8MTXP01CPIIZ.13.59.F04.1.454.CMB.2.raw
  modified_base (206)..(206): a, c, t, g, unknown or other
  modified_base (226)..(226): a, c, t, g, unknown or other
  modified_base (333)..(333): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagngtcaccgtcacgttgccggnagtcacgacattaacacttattagcctgtatcagcagaagcaggagagtaccctaaattatgatctctgctgcgtcgcttgcaacgtcgggggtaccatctcgttanaggtggcggttggatcgtaggactagtaaattcactctcactactcaaccgacctgccaccctagaagtattagttaggggtaatttattaccgtagttacacgtacctataggtgtcggccctctctaagtttcggcgggtacggccgaaaggtgcgagagtaacgaaacgaactggtgacgttcgaacgtaacc

SEQ ID NO: 389667 - DNA, 517 bp, Homo sapiens
  misc_feature: GZ8MTXP01C20M7.13.59.F04.1.454.CMB.2.raw
  modified_base (225)..(225): a, c, t, g, unknown or other
  modified_base (260)..(260): a, c, t, g, unknown or other
  modified_base (377)..(377): a, c, t, g, unknown or other
  modified_base (382)..(382): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctctggagacagagtcacgtcacttggccggnagtcacgacattaacacttattagcctggtatcancagaagcaggagagtccctaaatatgaatctctgctgcgtccgccttgcaacgtcgggggtccagtctcggttcagtggcgtggatctaggacagaatcactctcacatcacaactncaccnaagatgttagggaagtttatactgtacagtacctagtaagtggtcggccggcttcgtaacgttttcgggcgggtagggaacccgtaagggtgaccgaggataacgaaaacgaacgtggtacggctcggctaaccc

SEQ ID NO: 389668 - DNA, 554 bp, Homo sapiens
  misc_feature: GZ8MTXP01EV2QN.13.59.F04.1.454.CMB.2.raw
  modified_base (215)..(215): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacacttattagcctggtatcagcagaagccagggagagtacctaaattattgatctctgctgcgtccgctgcaacgtcgggggtccatctcggttcagtggcggtgatcgtaggacagaattcactctcacatcaaccacctgccaccctgaacgattaggttggggtaaagtttattacgtagtacagtaccttagtaggttcggtcggcccgtcgtccgtaagttttcgggacggggtacggggaacccgtaagggtcgacgaggaattaaccgaaaacggtaacgtaggtcgggttactcggccgtaacccg

SEQ ID NO: 389669 - DNA, 570 bp, Homo sapiens
  misc_feature: GZ8MTXP01EET02.13.59.F04.1.454.CMB.2.raw
  modified_base (201)..(201): a, c, t, g, unknown or other
  modified_base (227)..(227): a, c, t, g, unknown or other
  modified_base (461)..(461): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggnagtcacgacattaacacttattagcctggtatcagcagaagccgagggagagtacccctaaagttattgaatctctgctgcgtccgcttgctaacgtcggggtccatcgtcggtacagtggcggtggatcgtagggacagaattcactctcacatccaaccaacctgaccaccctagaagtagtgttagggaacgtttattactgtacagtacctagtacgtggtcgacccgtntcgtaacggtttcggacgggtaacgggacccgaagggttacgaccgagttaacgttaacgaaaaccggtaaccgtttgggacggttccgttcgggttaaccgtaacccg

SEQ ID NO: 389670 - DNA, 490 bp, Homo sapiens
  misc_feature: GZ8MTXP01ATXNW.13.59.F04.1.454.CMB.2.raw
  modified_base (275)..(275): a, c, t, g, unknown or other
  modified_base (398)..(398): a, c, t, g, unknown or other
  modified_base (417)..(417): a, c, t, g, unknown or other
  modified_base (422)..(422): a, c, t, g, unknown or other
  modified_base (460)..(460): a, c, t, g, unknown or other
  modified_base (464)..(464): a, c, t, g, unknown or other
  modified_base (467)..(467): a, c, t, g, unknown or other
  modified_base (470)..(470): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagagccaggganagtccctaaattattgatctctgctgcgtccgccttgcaacgtcgggggtccatctcggttcaggtggcggtggatcgtagggacagaattcactctcaccatcaccaacctgcaccctgaanatgtaggggaattattacngtacngatatagtgtgcgctctaattcgttcggaggaccgagngcgnganaanaacgaactagtggctcgcgc

SEQ ID NO: 389671 - DNA, 591 bp, Homo sapiens
  misc_feature: GZ8MTXP01EX9B8.13.59.F04.1.454.CMB.2.raw
  modified_base (228)..(228): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttggccgggnagtcacgactattaacacttattagcctggtatcagcagaagcgagggagacgtacctaaattatgatctctgctcgcgtccgccttgcgtaacgtccggggtacctagtctcggttacaggtggcgggtggagtgtaggacagtaactcactctacacactcaacccactcgaccaccgtagaacgtagtaggttaggggtaatttattacgtagtactacgtacgttagtacgggtcggtccggtcccgtcgttcgttaacggtttcgggacggggaacgggttaccggtaagggtcgaccgttaaggttaacgtaacgaaaaccggtaacgttcggcgggttaccttcggcccgtaaccg

SEQ ID NO: 389672 - DNA, 528 bp, Homo sapiens
  misc_feature: GZ8MTXP01AQG94.13.59.F04.1.454.CMB.2.raw
  modified_base (390)..(390): a, c, t, g, unknown or other
  modified_base (395)..(395): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccaggagagtaccctaaattatgatctctgctgcgtccgtcttgcgaacgtcgggggtccagtcgtcggttacaggtggtcggtgggatcgtaggacagaactcactctcacatcaccactncaccnagatgtaggtaagttatatgtcagacttagtagtcggtccgccgtctcgtaacgtttcgggcggtagggcccgaaagggtcgacgttacgactaaccgtaaaacggaaccttgggtacgcgtcggctaacccg

SEQ ID NO: 389673 - DNA, 605 bp, Homo sapiens
  misc_feature: GZ8MTXP01A5GDO.13.59.F04.1.454.CMB.2.raw
  modified_base (204)..(204): a, c, t, g, unknown or other
  modified_base (233)..(233): a, c, t, g, unknown or other
  modified_base (279)..(279): a, c, t, g, unknown or other
  modified_base (298)..(298): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcgttgganacagacgtccaccgtcacgttggccgggnagtcacgacattaacacttattagcctggtatcagcagagcagganacgtacctaatatgatctntgctgccgtccgctgcgtaacgtccggggtccagtcgtcggttacgaggtggcggtgatcgaggacagtaacttcactctcacactcaccactgaccacccgtagaacgtagttaggttaggggtaaacgtttatttacgtacgtacgtaacgtaccgttagtacggttcggtaccggtccccgttcttacgttaacggttttcccgggacgggtaaacggggttacccgtaaagggttcgacgaacggttaactaaccggaaaaccgtaacgttcgggtacggttaccgttcggaaccttaacccg

SEQ ID NO: 389674 - DNA, 574 bp, Homo sapiens
  misc_feature: GZ8MTXP01BRKYL.13.59.F04.1.454.CMB.2.raw
  modified_base (203)..(203): a, c, t, g, unknown or other
  modified_base (217)..(217): a, c, t, g, unknown or other
  modified_base (230)..(230): a, c, t, g, unknown or other
  modified_base (297)..(297): a, c, t, g, unknown or other
  modified_base (307)..(307): a, c, t, g, unknown or other
  modified_base (434)..(434): a, c, t, g, unknown or other
  modified_base (476)..(476): a, c, t, g, unknown or other
  modified_base (505)..(505): a, c, t, g, unknown or other
  modified_base (534)..(534): a, c, t, g, unknown or other
  modified_base (538)..(538): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctcccagataccagatgtgacatccagatcgacccagtctccactcctccctgtctgcatctctgganacagatccaccgtnacgttcggccggnagtcaacgacattaactacttattacgcctggtatcagacaagagccgaggagacgtacctaaattntagatctctncgtcgtccgtccgcttgcgtaacgtccggggtacctagtccgtcggttacgagggttcgggcggttaggacttaccgtaagggaactagtaacttacctactctaccacactaccaaaccctacacnccctaaccgagaagtagttaggttaggggtaatttacgtacngttacagtaacctgtacgtggtacgcctntcgtaagttcggcggtagggacgaaggtnacgngactaacgaacgtaagtcggagcctgttaaccctaa

SEQ ID NO: 389675 - DNA, 537 bp, Homo sapiens
  misc_feature: GZ8MTXP01A92GF.13.59.F04.1.454.CMB.2.raw
  modified_base (202)..(202): a, c, t, g, unknown or other
  modified_base (216)..(216): a, c, t, g, unknown or other
  modified_base (229)..(229): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtnacgttggccgggngagtcacgacattaacacttattagcctggtatcagcagagccgagggagacgtacctaaattattgatctctgctgcgtccgcttgctacgtcggggtccagtctcggtcaggtggcggtgatctaggacagtatcactctcacatccaaccacctgaccacctgaactagttgttagggtaagtttattactgtacacgtacgtagtacggtggtccgccgtcgtcgtaacgtttcgggacgggtacggaccgtaaggtcgacgagactaaccgaaacgtaacgtggtcggctcgaaccgtaaccg

SEQ ID NO: 389676 - DNA, 557 bp, Homo sapiens
  misc_feature: GZ8MTXP01DP8BI.13.59.F04.1.454.CMB.2.raw
  modified_base (215)..(215): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtccacgacattaacacttattagcctggtatcagcagaagccagggagagtccctaaattattgatctctgctgcgtccgccttgcaacgtccgggggtccagtctcggttcaggtgggcggtggatcgtaggacagtaaatcactctcacatccacaactgccaccctagaagatggttaggggtaagtttatttaactgtacagtaccttagtacggtggtcggcccgtcgttctaagttttcgggacgggtacgggttaccgtaaaggtcgacgttagaacgttaacgaaaacggtaaccgtgggtcggttctcggccgtaacccg

SEQ ID NO: 389677 - DNA, 594 bp, Homo sapiens
  misc_feature: GZ8MTXP01BJ855.13.59.F04.1.454.CMB.2.raw
  modified_base (200)..(200): a, c, t, g, unknown or other
  modified_base (290)..(290): a, c, t, g, unknown or other
  modified_base (377)..(377): a, c, t, g, unknown or other
  modified_base (381)..(381): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtccacgtcacgttggccgggcagtcaacgacattaacacttatttagcctggtatcagcaagagccaggagagtacctaaattntgatctctgctgcgtccgcttgcaacgtcgggggtcctagtccgtcggtcgagtcggcggtggatcgtaggacagtaattcacttcncacnctcaacccgaactcgaccacccttagaagtagttaggttagggggttaaagttttaattaaccgttggttacaacgtaacccgttagttaacgggttcgggtccgggccccgttacgttcgttaacgggtttccggggacgggtaacgggttacggtaaggtcgacgagttaacgtaacgtaaacgtcgtggtcgttcgtaacgttccgtaac

SEQ ID NO: 389678 - DNA, 551 bp, Homo sapiens
  misc_feature: GZ8MTXP01EPOZ2.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggcagtcaacgacattaacacttattagcctggtatcagcagaagccagggagagtaccctaaattactgatctctgctgcgtccgcttgcaacgtcgggggtccagtctcggttcagtgggcggtgatctaggacagtaacttcactctcacatcaaccaactgaccaccctgaagtatgttaggggtaagtttacttactggtactagaccttagtacggttcggttcgccccggtcttcgtaacgttttcgggacgggacgggttaccgaagggttcgagttagacgttaacgaaacgtaacgtggtggcttcggcgtaaccg

SEQ ID NO: 389679 - DNA, 560 bp, Homo sapiens
  misc_feature: GZ8MTXP01C61UT.13.59.F04.1.454.CMB.2.raw
  modified_base (201)..(201): a, c, t, g, unknown or other
  modified_base (227)..(227): a, c, t, g, unknown or other
  modified_base (275)..(275): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttgccgggnagtcacgacattaacacttattagcctggtatcagcagaagccagganagtaccctaaattactgatctctgtctgtccgtccgccttgctaacgtccgggggtccatcgtcggttacgagtggcggtgatcgtaggacagaatcactctacacactccaaccactcgaccaccctagaacgtatgttagggtaaagtttattacgtagtacaagtacctagtacggtggtccgtcccgtcttcgtaacgttttcgggacgggtacgggaacccgtaagggtcaccgagacgtaacgaaaacgtaacgttggacggttcttcggaactaaccg

SEQ ID NO: 389680 - DNA, 594 bp, Homo sapiens
  misc_feature: GZ8MTXP01BAD57.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagacgtcaccgtcacgttggccgggcgagtcacgacattaactacttattagcctggtatcagcagaagccagggagagtacctaaattatgatctctgctgcgtccgcttgctaacgtcggggtccagtcgtcggttcagtggcggtgatcgtaggacagaaattcactctacaccatccaacccaacctgccaaccctagaagtattcggttaggggtaacgtttaattacgtacgtcgtaacgtaccgttagtacggtcggtacggtcccgtcttcgtaacgttttcgggacggggtacgggttaacccgtaaaggggttcgaaccgaggttaacttaaccgaaaacggtaaccgttgggtggttacccgttggaacccgtaaacccg

SEQ ID NO: 389681 - DNA, 773 bp, Homo sapiens
  misc_feature: GZ8MTXP01B98D8.13.59.F04.1.454.CMB.2.raw
  modified_base (204)..(204): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgcatctcttgganacagagtctattatcacgttcggccggcctacttcgtaggtttggttgggtagggttggttcgtccgttggtactcgagacaaaacggccgaagggaccaaacgtaccccctaaactccgtagtacttcgtttaggacggtccgtttacgttaacggtttaagggaaccggggtactaccgtaccgtaacccccgtagggttacgacggtaccggtacgtaagggtacgtcgtcgtaacggggaacctacgtaaccttacccgaccctaccctaacccaacgttaccaaacgtacgtcccgtacggaccgtacgtaccgtaacggaaacgtaccttaccgtacgtaacccttaaaccggtttacctaacgttaccgttaaacccaacgttaaacgtttaaactttaaactttaaacccttttaagttaacccgtttaacgtttaccggggaaccggtaaacgggggtaaccttaaaaggggtcggaaacggtaaacgtaacccggttaaaacggttcgttcgggtaacggtacgtaaccgacctaccgttacgttccttcgtttaaccc

SEQ ID NO: 389682 - DNA, 632 bp, Homo sapiens
  misc_feature: GZ8MTXP01AFMQ1.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatcctccctgtctgcatctcttggagacagagtccaccgtcacgttggccgggcgagtccacgacattaactactttattagcctggtatcagcaggaagccgtagggagacgttaccctaaattattgattctctgtctgccgtccgccttgccgtaaccggtcgggggtcctagtccgtcggttacagggtgggcgggtgggtactgtacgggactagtaaattcacctctccaccactcccaacccaacctcgaccaaccctgaaacgtagttaggttacggggttaagtttacttaacgttcggtacaacggtcctaaagttcgggtcggtcggtacccgtacttcggtaacggtttcgggacggggtacggggacccgtaaagggtcgacgttagttaacgtaaccgtaaaacgggaacctttggggcggttccttcgaacccgtaacccg

SEQ ID NO: 389683 - DNA, 561 bp, Homo sapiens
  misc_feature: GZ8MTXP01BNHZJ.13.59.F04.1.454.CMB.2.raw
  modified_base (270)..(270): a, c, t, g, unknown or other
  modified_base (520)..(520): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagacgtccaccgtcacgttcggccgggcgagtccaacgactaattaacacttattagcctggtatcancagagcgaggagacgtcctaaagttatgatctctgctgcgtccgcttgctaacgtccggggtccagtcgtcggtcgagtgggcgggtgtagtcgtaggactagaacttcactctacaccataccaaccgaacctcgacctaccgtagaagtattggttagggtaacgtttattacctggtcagtacctagtaggtcggtcgtccctactctaacggtttcgggacgggacggttaccgaagggtgaacgngataacccgaaaagtcgttaggcggttactcgaaccgtaac

SEQ ID NO: 389684 - DNA, 608 bp, Homo sapiens
  misc_feature: GZ8MTXP01B8ADX.13.59.F04.1.454.CMB.2.raw
  modified_base (202)..(202): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtccaccgtcacgttggtcgggcgagtccaacgactaattaaaacttattagcctggtatcagcagaagccgaggagacgtaccctaaatttattgatctctgctgcgtcgcctgcgacgtccggggtcctatcgtcggtcgaaggtggcggtgtagtcgtaggacagtacttcactctacaccataccaacccactcgacctaccctagaacgtataggttacggtaaggtttacttacgttcggtacaagtacccttagtacggttcgggtcggtaccccgtcgttccgtaaggttttcccggggacgggttacgggtaccgttaaagggtgacgaacgttacgttaaccgaaacggtaacgttgggtcggtcgttacggtaacgttaacccgttaacg

SEQ ID NO: 389685 - DNA, 560 bp, Homo sapiens
  misc_feature: GZ8MTXP01AO55R.13.59.F04.1.454.CMB.2.raw
  modified_base (205)..(205): a, c, t, g, unknown or other
  modified_base (220)..(220): a, c, t, g, unknown or other
  modified_base (233)..(233): a, c, t, g, unknown or other
  modified_base (299)..(299): a, c, t, g, unknown or other
  modified_base (390)..(390): a, c, t, g, unknown or other
  modified_base (405)..(405): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgctatctcgttgganacagacgtcaccgtnacgttggccgggnagtcacgactaattaacacttattagcctggtatcagacagaacgcgaggagacgtacctaaattntgatctactgctcgccgtccgtcttgactaacggtccggggtacagtcgtcggtacaggtggcgggtgatcgtaggacagtaactcatccncaccatacccaaacncctcgaccaccgtagaagtacgttaggttaggggtaaactttagttactcggtactacgtaccttaaggtggttcggcggtacccctgtctaaggttcgggaggaccgagtaagggcagacttagaacgaaccgtaagtggcgactcgcgtaacg

SEQ ID NO: 389686 - DNA, 593 bp, Homo sapiens
  misc_feature: GZ8MTXP01DIMCN.13.59.F04.1.454.CMB.2.raw
  modified_base (205)..(205): a, c, t, g, unknown or other
  modified_base (464)..(464): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatcgacccagtctccactccctccctgtctgcattcttctggganacagacgtccaccgtcacgttcggccggggtcagtcaacgactaattaactacttattacgccttaggtatcagacaagaacgccggtaagggaacgtacgttaccctaaaatttcttagtaacttcgtctcgtctcggtccgttccgtcctttcgaccgtaacggtcccgggggtacctagttccgtcggttacgtagtcgggtcgtgggtatacgtaacggactagtaacttcacttcactacactacgacctaccncacactagatagttagttagtacttatactagtacagtacgtagtaggtcggtcgcctctcgttaacggtcgggacgggtacgacgtaggtcacgacgactaacgaagtcgtggcgttactcgaacgtc

SEQ ID NO: 389687 - DNA, 597 bp, Homo sapiens
  misc_feature: GZ8MTXP01D5CMI.13.59.F04.1.454.CMB.2.raw
  modified_base (203)..(203): a, c, t, g, unknown or other
  modified_base (217)..(217): a, c, t, g, unknown or other
  modified_base (230)..(230): a, c, t, g, unknown or other
  modified_base (442)..(442): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtnacgttggccgggnagtcacgacataacacttattagcctggtatcagcagaagccagggagagtacctaaagttatgatctctgctgcgtccgcttgcacgtccggggtcagtctcggtcagtggcggtgatcgtaagacgagtaaacttcaactctacaccactacgaacccaacttcacccaacctgaaagtattaggttaggggtaaagtttacttaccgtntacgtaacgtaccttagtaacgggtcgggtccgggaccccttcgttacggttaaacgttttccggggaacggggtaaacgggttaccgaaagggttagaccgaagggaactaacgaaaaccggttaatcgggttaggccttggaaccgttaaccg

SEQ ID NO: 389688 - DNA, 655 bp, Homo sapiens
  misc_feature: GZ8MTXP01B4ULX.13.59.F04.1.454.CMB.2.raw
  modified_base (235)..(235): a, c, t, g, unknown or other
  modified_base (287)..(287): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgcatctcgttggagacagacgtccaaccgtcacgttggccgggnacgtcaacgactattaactacttattacgcctgtatcagcagagccgagganacgtacctaaattatgatctctgctcggcgtccgtcgttgctaaccggtccggggtacctagtccgttacggttcgacgggtcgggtcgggtaggtacttaccgtaagggacgtaagtaaacttcctaacttccctacaccctactacccgtaaccctaaccgtcgaacctaccccgtaagtaaacgtagtttacggtttaacggggtaagtttttaactactacggtaccaaagttacccttaggttacggtcggtccgggccctcgttcgttaacgggtttccgggacgggacggttaccgaaaggtcgacgacgttaacgtaacgaaaaccggtcgttggtacggcttaacggaaccgttaaccg

SEQ ID NO: 389689 - DNA, 586 bp, Homo sapiens
  misc_feature: GZ8MTXP01EKK40.13.59.F04.1.454.CMB.2.raw
  modified_base (197)..(197): a, c, t, g, unknown or other
  modified_base (203)..(203): a, c, t, g, unknown or other
  modified_base (228)..(228): a, c, t, g, unknown or other
  modified_base (303)..(303): a, c, t, g, unknown or other
  modified_base (315)..(315): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctcccagataccagatgtgacatccagatcgacccagtctccatccctcctgtctgcatctnttgganacagactcacgtcacgtggccgggnagtcaacgactattaactacttattagcctggtatcagcagaagccagggagacgtacctaaattacttgatctntgctcgcgtccnctgctacgtcggggtcagtctcggtcaggtggcgtggatcgtaggacagtactcatctacacactcacctaactcgaccaccgtagaagtatggttagggtaagtttagttaccgtagtcaacgtaaccgttagtacggtggtccgggccttcgtacgttaacgggttttccgggacggggtaacggggttaacgtaacggggttagacccgttaagttaacgtaacgtaaaaacgtaaccggttgggcggacgttaacggccgtaacccg

SEQ ID NO: 389690 - DNA, 589 bp, Homo sapiens
  misc_feature: GZ8MTXP01CZZPP.13.59.F04.1.454.CMB.2.raw
  modified_base (201)..(201): a, c, t, g, unknown or other
  modified_base (575)..(575): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagacgtcaccgtcacgttggccgggcagtccacgacattaacacttattagcctggtatcagcagaagccgagggagagtaccctaaattattgatctctgtctcgccgtccgtccgttgacgtaacggtccgggggtcctagttccgtcggttacgaggtgggcgggtgggtagtcgtaggactagtaaacttcaactctacacctactaccaacccaacctcgtaccacccgtagaaagtacgttaggtttaggggtaaagtttatttacgtacgttacaagtacctagtacggtggtcggacccgtctcgtaagtttcgggagggtacgggacgtaagggtgacgttagactaacgaaacgtcgtaggnggttctgccgtaac

SEQ ID NO: 389691 - DNA, 566 bp, Homo sapiens
  misc_feature: GZ8MTXP01CIWW8.13.59.F04.1.454.CMB.2.raw
  modified_base (229)..(229): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacgttggccgggnagtcacgacattaacacttattagcctggtatcagcagaagccgaggagacgtaccctaaattatagactctctgctcgcgtccgcttgctaacgtccgggggtcctagtcctcggttcagtggcggtggagtcgtaggacagaacttcactctacacatacaaccaactcgaccaccgtagaaagtagttaggtttagggggtaaacgtttagttactacgttacaacgtaccttagtaggtcggtcgccgtactcgtaacgtttcgggacggtacgggaccgaaaggtgacgaggactaacgaaaacgtaacgttggcggactcggcgtaacccg

SEQ ID NO: 389692 - DNA, 615 bp, Homo sapiens
  misc_feature: GZ8MTXP01AFO64.13.59.F04.1.454.CMB.2.raw
  modified_base (354)..(354): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacgttggccgggcgagtcacgacattaacacttattagcctggtatcagcagaagcgaggagacgtacctaaattattgatctctgctgcgtccgcttgcgacgtcggggtccatcgtcggttcaggtggcgggtggntcgtaggacagtactcactctcacactcacccaactcaccaccctgaacgtagttgttaggggtaaagtttacttacgtacgttccgtaacgacccttaagtacgggttacggtccgggtcccgtccgttcgttaacggttttacggggccggggttaaacggggacccgtaaaggggttacggaccgaggttaacgttaacccggaaaacggtaacccgttagggtcgggttaccgttaacgggaacccgttaaaccccg

SEQ ID NO: 389693 - DNA, 748 bp, Homo sapiens
  misc_feature: GZ8MTXP01C7QDV.13.59.F04.1.454.CMB.2.raw
  modified_base (203)..(203): a, c, t, g, unknown or other
  modified_base (230)..(230): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcgttgganacagactcaccgtcacgttggccgggnagtcaacgacattaacacttaattacgcctaggtatcagacaaggaagaccgagggagtacgtaccctaaattattagtatctactgctcggtccgtccgctttcgacgtaaccgtccgggggtacctagttcgtacggttcgaggtcgggtcgggtaggtactcggttaaggaaccgtaaggttaaacttacctaacccgtttaccgtaaccctaaacccacgtttaaaccccaaacccccgtaaacccctttaccggaaacccctaaccccggttaaacggtaaacggttaaacggtttaacgggtttaacgggggtttaaaacggtttttaaagtttaccgtttaacggtaaccgtaacgtaacccgtttaagttaacggggttcgggtccgtaacccccggttgttccgttaacgggttttccggggaccgggttaaacgggaacccgtaagggtacgaccgaagttacttaacccgaaaaggtaaccgttggcggttactaacggcctaaccg

SEQ ID NO: 389694 - DNA, 639 bp, Homo sapiens
  misc_feature: GZ8MTXP01CU5XD.13.59.F04.1.454.CMB.2.raw
  modified_base (203)..(203): a, c, t, g, unknown or other
  modified_base (217)..(217): a, c, t, g, unknown or other
  modified_base (229)..(229): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttgganacagagtcaccgtnacttggccgggnagtcacgacattaacacttatttagcctaggtatcagccagagccagggagagtccctaaattattgatctctgctgcgtccgcttgctaacgtcgggggtccatctcggttacaggtggcggtggatcgtaggactagtaaacttcacttctaccacacttaccaaccgtaaaccttcgacctacccgtagaaagtagttacggtttaggggtaaagttttaagttaccgtacggttactaacggtaacccttagttaaacggtcggggttcgtccccgtaacgttcggttaacgttttccggggacgggttaacggggacccgtaaagggttcgaccgaagggaacttaacccggaaaaaacgtaacccgttaagggttcggggaaccttcgggcccgttaaaacccg

SEQ ID NO: 389695 - DNA, 514 bp, Homo sapiens
  misc_feature: GZ8MTXP01EVL8R.13.59.F04.1.454.CMB.2.raw
  modified_base (382)..(382): a, c, t, g, unknown or other
  modified_base (392)..(392): a, c, t, g, unknown or other
  modified_base (447)..(447): a, c, t, g, unknown or other
  modified_base (504)..(504): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttgccgggcagtcacgacattaacacttatttagcctggtatcagcagaagccagggagagtccctaaattattgatactctgctgcgtccgcttgcaacgtcggggtccatctcggtcagtggcggtggatcgtagacagattcactctcacatacaccactncacctagaanagtgttagggtaagtttaattactagtacacacctatacgtggtcggcccgtctntaagttttcgggcgggtacggaccgtaaggtgacgaggactaacgaaacgaattggngctgctaacc

SEQ ID NO: 389696 - DNA, 565 bp, Homo sapiens
  misc_feature: GZ8MTXP01EW5R3.13.59.F04.1.454.CMB.2.raw
  modified_base (201)..(201): a, c, t, g, unknown or other
  modified_base (230)..(230): a, c, t, g, unknown or other
  modified_base (393)..(393): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctcctgtctgcatctctgganacagagtccaccgtcacgttcggccgggnagtcaacgacaattaacacttattagcctggtatcagacagaagccgagggacgacgtaccctaaattattgtatctctgctgcgtccgtcttgctaacggtccggggtccagtctcggttacaggtggcggtgactcgtaggacagtaactcactctcaccntaccaaaccgactcgaccaccgtagaactagttagttagggtaacgtttattactggttacagaccgttagtacggtggtccgtcctacgttcgtaacggtttcgggacgggacggttaccgtaaggtgaccgttaggactaacgaaccgtaagttggacggctcgctaacc

SEQ ID NO: 389697 - DNA, 515 bp, Homo sapiens
  misc_feature: GZ8MTXP01DI9ZG.13.59.F04.1.454.CMB.2.raw
  modified_base (202)..(202): a, c, t, g, unknown or other
  modified_base (228)..(228): a, c, t, g, unknown or other
  modified_base (387)..(387): a, c, t, g, unknown or other
  modified_base (409)..(409): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtcacttggccgggnagtcacgacattaacacttattagcctggtatcagcagaagccaggagagtccctaaattattgatctctgctgcgtccgccttgcaacgtcgggggtccatctcgttcagtggcggtgatctaggacagatcatctcacatcacaactgcacctgaanatgtgggtaagttattactgtnagactagtagtggtgtccgctcgtaagttttcgggcgggtacggggaccgtaaagggtcgcgttaggacttaacaaaacgtaaccgtgtgggactgaaccgtaacc

SEQ ID NO: 389698 - DNA, 608 bp, Homo sapiens
  misc_feature: GZ8MTXP01EY3JV.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtccaccgttcacgttggccgggcgagtcacgacattaactacttattagcctggtatcagcagaagccgagggagacgtacccctaaattattgactctctgtcgtcgccgttccgccttgccggtaaccgtccgggggtcctagtcctcggttcagggtgggcgggtggtagtctaggaactagaaacttcactctacaccactaccacccaacccttcgcaaccccctgtaaggaagtagtttgggggtaacgttaatttaactaggtcctagtacccgttattagtcgggttgggccccgccgtttcgaacgttttacgggttccgggaagggggttcccgaaaggggtttacgagacgtaacgaaaccgtaacgtaggtcggactcgccgtaaccg

SEQ ID NO: 389699 - DNA, 531 bp, Homo sapiens
  misc_feature: GZ8MTXP01E2B82.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacttgccggggcgagtcacgacattaacacttatttagcctggtatcagcagaagccagggagagtcccctaaattattgatctctgctgcgtccgccttgcaactcgggggtccatctcggttcagtggcggtggatctaggacagaaattcactctcaccatcacccaacctgcacccctgaacgatggttcggggaagttattaactgtcaggaccctataggtggtggccccggtctctaacgttttcgggccgggaggggaccgaaagggtgccgttagactcgaaacgtaaccgtggtggctgcaaccc

SEQ ID NO: 389700 - DNA, 542 bp, Homo sapiens
  misc_feature: GZ8MTXP01ASY71.13.59.F04.1.454.CMB.2.raw
  modified_base (201)..(201): a, c, t, g, unknown or other
  modified_base (215)..(215): a, c, t, g, unknown or other
  modified_base (275)..(275): a, c, t, g, unknown or other
  modified_base (298)..(298): a, c, t, g, unknown or other
  modified_base (344)..(344): a, c, t, g, unknown or other
  modified_base (374)..(374): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatcctccctgtctgcatctctgganacagagtcaccgtnacttggccgggcagtcacgacattaacattatttagcctggtatcagcagaagccagganagtaccctaaattattgatcgtntgctgcgtccgaccttgcaacgtccgggggtccatcgtcggttcgnggtggtcgtgactgagacagtactcactcncacacaccaccactcacacgtagaagtagttagtagggtaagttagtacgtagtacagtacgtagtcggtcggtcgtcctcgtcgttcggttcgggacgggtacggacgtaggtcgacgttacgacgtaacgaaacgtaacgtcggtacgttacctaacgccgtaacg

SEQ ID NO: 389701 - DNA, 516 bp, Homo sapiens
  misc_feature: GZ8MTXP01BS96H.13.59.F04.1.454.CMB.2.raw
  modified_base (428)..(428): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggcagtccacgacattaacacttattagcctggtatcagcagaagccaggagagtcccttaaattattgaatctctgtctgcgtccgccttgcaacgtccgggggtccagtcgtcggttacaggtggacggtggatcgtaggacagaattcactctcacatcaccaacctgcacctgagatagttgggtagttattactcttanagtacgtagtagtggtcgtcgtctcgtcgttcggcgggacggacgaggtgacgacgacgtaacaacgtaacgtcgtgcgtcgcgtaac

SEQ ID NO: 389702 - DNA, 504 bp, Homo sapiens
  misc_feature: GZ8MTXP01EVIV4.13.59.F04.1.454.CMB.2.raw
  modified_base (215)..(215): a, c, t, g, unknown or other
  modified_base (226)..(226): a, c, t, g, unknown or other
  modified_base (235)..(235): a, c, t, g, unknown or other
  modified_base (382)..(382): a, c, t, g, unknown or other
  modified_base (387)..(387): a, c, t, g, unknown or other
  modified_base (391)..(391): a, c, t, g, unknown or other
  modified_base (435)..(435): a, c, t, g, unknown or other
  modified_base (448)..(448): a, c, t, g, unknown or other
  modified_base (469)..(469): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacganattaacacttattagcctggtatcagcagaagccaggagagtccctaaattattgatctctgctgcgtcgccttgcaacgtcgggggtccatctcggttcagtggcggtggatcgtaggacagaattcactctcacatcaccacctncaccngaanatgttgggaagtttattactgtcagacctatagtggtgcccgtntcgaattttcggnggtacgggaccaagggtgcgnggataacgaaagaaccgtagtcggactggctaacc

SEQ ID NO: 389703 - DNA, 634 bp, Homo sapiens
  misc_feature: GZ8MTXP01AYNGH.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctacatctcttgganacagagtcaccgtcacttgccgggcagtcacgacattaacacttattagcctggtatcagcagaagccagggagagtaccctaaattattgatctctgctgcgtccgcttgcaagtccggggtccatctcggtcaagtggcgtggatctagacagaacttcactctcacactacaccaacctcgaccacccttagaacgtattgttaggtaaaggggttttaactttaccgttacggttacgtaacgtaaccccgtttaagttaacgggttacggggttcgggtcccccggtacgtttcccgtaacgggttttttcccggggaccggggttaagggggttaaaccccgaggggttacggacccgaaggttaacgttacgaaaacccgggtaacgttaaggttcggggcccttacggccgaacccgtttaaccg

SEQ ID NO: 389704 - DNA, 562 bp, Homo sapiens
  misc_feature: GZ8MTXP01D0DLX.13.59.F04.1.454.CMB.2.raw
  modified_base (201)..(201): a, c, t, g, unknown or other
  modified_base (215)..(215): a, c, t, g, unknown or other
  modified_base (227)..(227): a, c, t, g, unknown or other
  modified_base (348)..(348): a, c, t, g, unknown or other
  modified_base (434)..(434): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttggccggnagtcacgacataacacttattagcctggtatcagcagaagccgagggagacgtaccctaaattatagatctctgctcgcgtccgcttgactaacgtcggggtccatcgtcgttacagtggngtgatcgaggacagtactcactctacaccatacccaaccaacctcgacccacccgttagaaagtattagggtttaggtaaagtttnttaacgtcgtacagtacctagtagtcggtcgccgtctctaagtttcggacgggtacggaccgtaaggtcgaccgagaacgttaacgaaaacgtaacgtcggtacggttctaacggttaaccgtaaccg

SEQ ID NO: 389705 - DNA, 562 bp, Homo sapiens
  misc_feature: GZ8MTXP01EZOX9.13.59.F04.1.454.CMB.2.raw
  modified_base (229)..(229): a, c, t, g, unknown or other
  modified_base (279)..(279): a, c, t, g, unknown or other
  modified_base (311)..(311): a, c, t, g, unknown or other
  modified_base (433)..(433): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacgttggccgggngagtcacgacattaacacttattagcctggtatcagcagagccgaagganacgtacctaaattatgatctctgctgcgtccncttgctacgtccggggtcagtcgtcggttcagtggcggtagagtctaggacagtacttcactctacacatcaaccaacctgccaccgtagagtatagttaggggtaagtttattactcgtanacgtaaccttagtaacgggttggtccggtccgtcgtcttcggttttcgggacgggacggttaacccgaaggtcgaccgttagacgtaaccgaaacgtaaccgtgttacgggcttaacggcgtaaacccg

SEQ ID NO: 389706 - DNA, 535 bp, Homo sapiens
  misc_feature: GZ8MTXP01AGGL0.13.59.F04.1.454.CMB.2.raw
  modified_base (228)..(228): a, c, t, g, unknown or other
  modified_base (498)..(498): a, c, t, g, unknown or other
  modified_base (524)..(524): a, c, t, g, unknown or other
tcagtcacgtactacacgaccggtgctcgatttagtacacacacttagggattgggggcagaagtctctctcagtcaggacacagcatgggcatgagggtccctgctcagctcctgggactcctgctgctctggctcccagataccagatgtgacatccagatgacccagtctccatccctccctgtctgcatctcttggagacagagtcaccgtcacttggccgggnagtcacgacattaactacttattagcctggtatcagcagagcaggagagtacctaaattatgatctctgctgcgtccgcttgcgtaacgtccggggtccagtcgtcggttcaggtgggcggtggatcgtaggacagtaaatcactctacaccactaccaacccacctgccaaccctagaagtattagttaggggtaattattactgtacagtacctagtagtggtacgcccgtctcgtaagtttcgggcggtaacgggaccgtaaaggtnacgagactaaccgaaagaacgtaggnggctgctaacc

SEQ ID NO: 389707 - DNA, 626 bp, Homo sapiens
  misc_feature: GZ8MTXP01CLP0Q.13.59.F04.1.454.CMB.2.raw
  modified_base (386)..(386): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccacttccctccctgtctgcatctcttggaagacagacgtccaccgtcacgttcggccgggcagtcacgacaattaactacttattagcctgtatcagcagaacgcgaggagacgttaccctaaattattagtatctctgtcgtcggccgttccgtccttcgaccgtaaccggtccgggggtacctagttccgtcggttccgaggttcgggnggtagggactcgtagggactaagtacttcactctacaccataccaccaacctcgacctaccagtaaagagttaggttaggggtaacgtttattacgtggtacaacgtaccgttaagttacggtcggtccgggtcccgtcttacggttaacgtttccgggggacgggtaacgggaacccgtaagggttcgacgacgttaacgtaacgaaaccggaattgggtacggcttcgaacttaaccg

SEQ ID NO: 389708 - DNA, 554 bp, Homo sapiens
  misc_feature: GZ8MTXP01EL58W.13.59.F04.1.454.CMB.2.raw
  modified_base (200)..(200): a, c, t, g, unknown or other
  modified_base (213)..(213): a, c, t, g, unknown or other
  modified_base (225)..(225): a, c, t, g, unknown or other
  modified_base (297)..(297): a, c, t, g, unknown or other
  modified_base (381)..(381): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctgganacagagtcacgtnacttggccgggnagtcacgacattaacacttattagcctggtatcagcagaagccgagggagacgtacctaaattattgatctntgctgcgtccgctgcgaacgtccgggggtcagtctcggttacagtggcgggtggatcgtaggacagtaacttcactctcaccancctaaccacctgccacctagaatatggttagggtaaagttattaactgtactagaccttagtacgttggtcggccctcgtctaaggttttcgggcgggtaacgggaaccgtaagggtccgacgttaggacttaaccgaaacgaaccgttgtcggggcttaacggcgtaacccg

SEQ ID NO: 389709 - DNA, 531 bp, Homo sapiens
  misc_feature: GZ8MTXP01EUHOD.13.59.F04.1.454.CMB.2.raw
  modified_base (201)..(201): a, c, t, g, unknown or other
  modified_base (226)..(226): a, c, t, g, unknown or other
  modified_base (339)..(339): a, c, t, g, unknown or other
  modified_base (401)..(401): a, c, t, g, unknown or other
  modified_base (417)..(417): a, c, t, g, unknown or other
  modified_base (422)..(422): a, c, t, g, unknown or other
  modified_base (426)..(426): a, c, t, g, unknown or other
  modified_base (446)..(446): a, c, t, g, unknown or other
  modified_base (517)..(517): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcacgtcacttggccgggnagtcacgacattaacacttattagcctggtatcagcagaagccgagggagagtaccctaaattattgatctctgctgcgtccgctgcaacgtcggggtccatcgtcgttaacnggtggcgggtgatcgtaggacagtaacttcactctcacatcaacccaactgaccacctgaangttgtagggtaagttnttacngtanagactataggtgtcggtccngtctaagttttcgggcggtaacgggccgtaaaggtgaccgaggttactaacgaaaaccgaagttacggggngttcgtcgctaacg

SEQ ID NO: 389710 - DNA, 654 bp, Homo sapiens
  misc_feature: GZ8MTXP01A0WAI.13.59.F04.1.454.CMB.2.raw
  modified_base (202)..(202): a, c, t, g, unknown or other
  modified_base (229)..(229): a, c, t, g, unknown or other
  modified_base (246)..(246): a, c, t, g, unknown or other
  modified_base (277)..(277): a, c, t, g, unknown or other
  modified_base (291)..(291): a, c, t, g, unknown or other
  modified_base (298)..(298): a, c, t, g, unknown or other
  modified_base (410)..(410): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctgactcccagataccagatgtgacatccagatgacccagtctccatcctccctgactgctatctcttgganacagagtcaccgtcacgttggccgggnagtcacgactattaacncttattagcctggtatcagcagacgcagganacgtacctaaattntgatctntgctgccgtccgacttgactaacggtcgggtacgtactacgtcgtcgtagtgggcgtggtagacttaggacagtaactactactaccttcaccaactactaaccgaccctanccaaccacgaatacgttagttagggggtaatttacttacgttcgtacgttacaccgttaacgttaaggtcgggtccggtaccgtcccgttgttaacgggttttaccggttacgggggaaaccgggttaaacccggtaacgggtaaagttcccggggttaaaaacgttaaaccgggtaaacccgtaaaaccggggttaaaccgttcgggttaaccggttaccggttaaccgttaaccgtaacccg

SEQ ID NO: 389711 - DNA, 697 bp, Homo sapiens
  misc_feature: GZ8MTXP01CPV15.13.59.F04.1.454.CMB.2.raw
  modified_base (204)..(204): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgcatctcttgganacagagtccaccgtcacgttcggccgggcagtcaacgacattaacacttattagcctggtatcagcaagaagccgagggagacgtacccttaaattattgaatctctcgtctcgccgtccgtctgacgtaaccggtccgggggtaccagttccgtcggttaacgcgggtcgggcggtagggacgttacgtagggaactacggtaaacttcccaactcctaccaaccaacttacccaaaccctaaacccgttcggaacccaaccccgttaggaaaggtacgttagggtttaacggggttaaaggttttaactttacgtacgttaccgtaacgtaacccgttaaaggtacgggttcgggtaccgggtccccgtcgttacggttaacggttttccggggacggggtaacggggttacccgtaaagggtcgaacgttaacggttaacgttaaccgaaaacggtcgttaggttcgggttactccgggaacttaacccg

SEQ ID NO: 389712 - DNA, 508 bp, Homo sapiens
  misc_feature: GZ8MTXP01CCOUF.13.59.F04.1.454.CMB.2.raw
  modified_base (201)..(201): a, c, t, g, unknown or other
  modified_base (227)..(227): a, c, t, g, unknown or other
  modified_base (393)..(393): a, c, t, g, unknown or other
  modified_base (416)..(416): a, c, t, g, unknown or other
  modified_base (439)..(439): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggnagtcacgacattaacacttattagcctggtatcagcagaagccagggagagtaccctaaattattgatctctgctgcgtccgccttgcaacgtcgggggtccatctcggtcagtggcggtggatcgaggacagaattcactctcacatcaccaactgcacctgaanatgttaggggaattattactgtnagacctatagtggtcgccgtctntaacgtttcgggcggacgggaccgaaagggtgacgagactaacaaagaacgtgtacggctgcgtaaccc

SEQ ID NO: 389713 - DNA, 544 bp, Homo sapiens
  misc_feature: GZ8MTXP01EHNWT.13.59.F04.1.454.CMB.2.raw
  modified_base (216)..(216): a, c, t, g, unknown or other
  modified_base (229)..(229): a, c, t, g, unknown or other
  modified_base (296)..(296): a, c, t, g, unknown or other
  modified_base (395)..(395): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtnacgttggccgggnagtcaacgacattaacacttattagcctggtatcagcagagcaggagagtccctaaattatgatctntgctgcgtccgcttgctaacgtccgggggtcatctcggttcagtggcgtgatcgtaggacagtatcactctacacatacaaccaacctgcaccctaganatgttagggtaagtttattactgtacagtacctagtacgtgggtcggcccgtacttcgtaacggtttttcgggacgggtaacggggacccgtaaaggttcggaccgaggttaactaacgaaaacgtaacgttgaggactgaacgtaacc

SEQ ID NO: 389714 - DNA, 664 bp, Homo sapiens
  misc_feature: GZ8MTXP01B9G3T.13.59.F04.1.454.CMB.2.raw
  modified_base (279)..(279): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagagtcaccgtcacgttcggccgggcgagtcacgacattaacacttattagcctggtatcagcagaagcaggganagtacctaaattattgatctctgctgtccgtcgccttgctacgtccggggtcagtcgtcggttacgaggtcgggcgggtggtacgtcgtaacgggaactaggtaacttcctaaccttccttacccaaccctaacttacccaaacccctaaccccgttcgtaccccgaaccccttagggaaacgtaagtttaccgggtttaagggggttaaacgtttttaacgtttaccgttaggtaccttaacgacccgtttaagtacggttcgggtaccgggtccccgtcttcgttaacggtttcggggccggggtaaacgggaccgtaaagggttgaccggttaacgacgtaacgtaaacgtaacgttacggtcggactcggaacgtaacccg

SEQ ID NO: 389715 - DNA, 693 bp, Homo sapiens
  misc_feature: GZ8MTXP01C35LA.13.59.F04.1.454.CMB.2.raw
  modified_base (326)..(326): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgctatctcttggagacagacgtccaccgtctacgttcggccgggcgagtcaacgaactaattaactacttatttacgcctggtatcagacaagaacgccgagggagtacgtaccttaaattattagatctctgtcngtccgtccgtcttgacgtaccgtccgggggtacctagtccgtcggttacgtagggtcgggcgggtaggtaacgtacgtaacgggactaacgtacttacctactctaccacctactaccaacctaacctcgaccacccgtagaaagtagttaggttaagggttaaacgtttaagttactacggtaactaacgtaccgttaggttaacgggttcggtccgggtccccgtacgttccgtttaacgggttttcccggggaacggggttaaccggggaaaccggtaaagggttacggttaaccgaaggttaaccttaaacggaaaaaccggtaacggttcgggtacgggttacttccggaaccgttaacccg

SEQ ID NO: 389716 - DNA, 625 bp, Homo sapiens
  misc_feature: GZ8MTXP01B3WW8.13.59.F04.1.454.CMB.2.raw
  modified_base (203)..(203): a, c, t, g, unknown or other
  modified_base (282)..(282): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcgttgganacagagtccaccgtctacgttggccgggcagtcaacgacattaacacttattagcctggtatcagcagagccgaggganacgtaccctaaattatgatctctgctcgcgtccgccttgcgtaaccggtccgggggtcctagtccgttcgggttccagggttgggacgggtggtacgttcgtaacggacgaggtaaacttccactctcacctactcaaccctaacctcgaccacccgtagaacgtgttaggttaggggtaagttttattactcgtactacgtaccgttagtacggttcgggtccggtcccgtcttccggtaacgttttccgggggacgggtacggggttaccgtaaaggggtcgacgacgacgttaaccggaaacgtaaaccggttggtacggcgttaacgggccttaacccg

SEQ ID NO: 389717 - DNA, 518 bp, Homo sapiens
  misc_feature: GZ8MTXP01AVAY9.13.59.F04.1.454.CMB.2.raw
  modified_base (226)..(226): a, c, t, g, unknown or other
  modified_base (306)..(306): a, c, t, g, unknown or other
  modified_base (494)..(494): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccaggagagtccctaaattattgatctctgctgcgtccncttgcaactcggggtcatctcgttcagtggcgtgatcgtaggacagtaatcactctcacatcaccaactgccacctagaagatgttaggggtaagtttacttaactcggttacacgtaccgttataggtcggtcggcccgtctcgtaagtttcggacgggacggttaccgaaaggtgacgagactaanaaccgaattgaggctggttcaacc

SEQ ID NO: 389718 - DNA, 596 bp, Homo sapiens
  misc_feature: GZ8MTXP01AFG8W.13.59.F04.1.454.CMB.2.raw
  modified_base (203)..(203): a, c, t, g, unknown or other
  modified_base (284)..(284): a, c, t, g, unknown or other
  modified_base (304)..(304): a, c, t, g, unknown or other
  modified_base (353)..(353): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttgganacagacgtccaccgtcacgttcggccgggcgagtccaacgacattaactacttattagcctggtatcagcagagccagganacgtacctaaatatgatctntgctgctccgtctgcgtacgtccggggtcagtcgtcggttcgagtcggnggtggatcgtaggacagtaactcactctacactactccaaccactcgacctaccgtagaaagtagttaggttagggtaaacgtttacgttacgtacgtacctagtacctagttacgggtcggtccggacccgtcttcggtaagtttccggggacgggtacgggaacgtaacgggtacgaccgaagttaacgtaaaccgaaaacggtaacgttacgggcgggttactccggttaacgtaacccg

SEQ ID NO: 389719 - DNA, 530 bp, Homo sapiens
  misc_feature: GZ8MTXP01AL7I2.13.59.F04.1.454.CMB.2.raw
  modified_base (201)..(201): a, c, t, g, unknown or other
  modified_base (226)..(226): a, c, t, g, unknown or other
  modified_base (493)..(493): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagagccagggagagtaccctaaattattgatctctgctgcgtcgcttgcgaacgtcgggggtccagtctcggtcagtggcggtgatctagggacagaattcactctcaccatcaccactgccaccgtgaacgtatggtaggggtaagttattacgtagtacagtacctagtaggtggtcgcccgtctcgtaacgtttcgggcgggtacgggacccgtaaagggtcgaccgnggaactaacgaaacgaacgtgtgggctggcgtaaccg

SEQ ID NO: 389720 - DNA, 527 bp, Homo sapiens
  misc_feature: GZ8MTXP01B656M.13.59.F04.1.454.CMB.2.raw
  modified_base (228)..(228): a, c, t, g, unknown or other
  modified_base (470)..(470): a, c, t, g, unknown or other
  modified_base (490)..(490): a, c, t, g, unknown or other
  modified_base (515)..(515): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggnagtcacgacattaacacttattagcctggtatcagcagaagccgaggagacgtacctaaattatgatctctgctgcgtcgctgcaacgtccgggggtccagtctcggtcaggtggcggtggatcgtaggacagatcactctcacatcaaccaacctgaccacctagaagattcggttaggggaatttattacctaggtcaacgtacctagtacggtgtcggccctcgtcgtaagtttcgggngggtacgggacgtaagggtnacgaggactaacaaacgaagttagngggctgcctaac

SEQ ID NO: 389721 - DNA, 618 bp, Homo sapiens
  misc_feature: GZ8MTXP01AH8KQ.13.59.F04.1.454.CMB.2.raw
  modified_base (203)..(203): a, c, t, g, unknown or other
  modified_base (230)..(230): a, c, t, g, unknown or other
  modified_base (607)..(607): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctcctgtctgcatctcgttgganacagactcaccgtcacgttggccgggnacgtcacgactattaactacttattagcctggtatcagcgaagacgccgagggagtacgtaccgtaaattatagatctctgctcgccgtccgtcttgacgtaaccggtccgggggtctacgttcgttcggttacgtagggtcggggtcgggtagggtacgttacgtaagggaactaacggttaacttcctacttcctaccaccgtaaccttacccaaccctaaacctcgaccctaacccgtagtaacgtagttaggttaacggggttaagtttacgttactacggtactaacggtacctagtcggtcggtcgccctagttcgtaaggttcgggagggtcggaacgtaggtcgacgttgactaacgaaagtcgttggngctgccgtaac

SEQ ID NO: 389722 - DNA, 564 bp, Homo sapiens
  misc_feature: GZ8MTXP01BK6BV.13.59.F04.1.454.CMB.2.raw
  modified_base (202)..(202): a, c, t, g, unknown or other
  modified_base (217)..(217): a, c, t, g, unknown or other
  modified_base (230)..(230): a, c, t, g, unknown or other
  modified_base (297)..(297): a, c, t, g, unknown or other
  modified_base (428)..(428): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgctatctcttgganacagacgtcaccgtnacgttggccgggnagtcaacgactattaacacttattagcctggtatcagcagaacgccgaaggagacgtacctaaattntagatctctgctgcgtccgtcttgcgtaacgtccggggtaccagtctcggttacgaggtcgggcggtggactcgtaaggacagtaaacttcactctacacctatcccgaacctacgtcactacccgagaanagttgttaggggaatttagtactaggtacagtactagtaggtcgtaccgtccgtctcgtaacggtttcgggacggacggaccgtaaggtcgaacgaggaacttaacgaaacgtaagttcggagccgttgccgtaac

SEQ ID NO: 389723 - DNA, 593 bp, Homo sapiens
  misc_feature: GZ8MTXP01D2NU8.13.59.F04.1.454.CMB.2.raw
  modified_base (202)..(202): a, c, t, g, unknown or other
  modified_base (231)..(231): a, c, t, g, unknown or other
  modified_base (305)..(305): a, c, t, g, unknown or other
  modified_base (404)..(404): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtccaccgtcacgttcggccgggngagtccacgactattaacacttaattacgcctggtatcagacagaagcgaggagagtacctaaattatgatctntgctgcgtccgctgactaacggtccggggtccagtcgtcggttacagtgggcggtggatcgtaggacaagtaacttcactcacacactacaaccacgtnaccacctagaagtagtagtttacgggggtaaatttattactagtctaagtactagtacgtggtacgccctacttcgtaagtttccgggacggggtacggttaccgaaaggggttcgaccggttaaggttaactaaccgtaaaaccggtaacggttacgggttcggggaaccttcgggaacccttaaccg

SEQ ID NO: 389724 - DNA, 560 bp, Homo sapiens
  misc_feature: GZ8MTXP01B90DG.13.59.F04.1.454.CMB.2.raw
  modified_base (201)..(201): a, c, t, g, unknown or other
  modified_base (215)..(215): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttgccgggnagtcacgacattaacacttattagcctggtatcagcagaagccaggagagtacctaaattatgatctctgctgcgtccgtccttgctacgtccgggggtcctagtcgtcggttcaggtggcggtggatcgtaggacagtaattcactctcaccactccaacccacctcgccaccttacgaagtagttggttaggggtaagtttattacgttgtacaacgtaccgttagtaggtcgggtcggtcccgtcgttcgtaacgttttcgggcgggtacgggaccgtaaggtgttaccgagactaacgaaacgtaacgtggtacggctggccgtaaccg

SEQ ID NO: 389725 - DNA, 643 bp, Homo sapiens
  misc_feature: GZ8MTXP01DJTGB.13.59.F04.1.454.CMB.2.raw
  modified_base (207)..(207): a, c, t, g, unknown or other
  modified_base (387)..(387): a, c, t, g, unknown or other
  modified_base (396)..(396): a, c, t, g, unknown or other
  modified_base (428)..(428): a, c, t, g, unknown or other
  modified_base (558)..(558): a, c, t, g, unknown or other
  modified_base (588)..(588): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctcccagataccagatgtgacatccagatcgacccagtcctccattccctccctgtctgcatctcgttgganacagacgtccaccgtcacgttcgggcccgggacagtccaacgaactaattaaactactttattaacgcctaggtactcagacaagaacgccgagggagacgtaccttaaattacttgatctctgtctcgtccgtccgtcgtgccgtaacgtccgggggtacctgttccgtcggttaacgnggtcggggngggtgggactacgtaacgggacagtaacttcnctctacaccactaccaaccgtacctacgacctacctagtaaacgtagtttaggttaggggttaaatttattacctggtactacgtaactagttacggtcggtacgccgtcttcgttaacggtttacgggngggtaacggaccgttaagggcgttaaccgnggttaactaacccgtaaaaacgtcggttaaggtcgggcttaacggccgttaaccg

SEQ ID NO: 389726 - DNA, 612 bp, Homo sapiens
  misc_feature: GZ8MTXP01AYUBT.13.59.F04.1.454.CMB.2.raw
  modified_base (200)..(200): a, c, t, g, unknown or other
  modified_base (214)..(214): a, c, t, g, unknown or other
  modified_base (224)..(224): a, c, t, g, unknown or other
  modified_base (271)..(271): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtnacttgccggnagtcacgacattaacacttattagcctggtatcagcagagccagganagtccctaaattatgatctctgctgcgtcgcttgcaacgtcggggtcagtcgtcgtacagtcggcgtgtactcgtagactaggtacttcgaactcgtaccacctactaccgaaccctacttacgaccctaccccgttaggaaacgtacgttacgttacgggggtaaacgtttacttaaccgtcggttacgaacgttacccgttagttaacggtcggtcggacccgtcgttcgtaaaggttttccggacgggtacgggttaccgtaacgggttcgacgttacgttacgtaacgtaaaacggtaacccgttggtacggttaccgtcgttaaccgttaacccgg

SEQ ID NO: 389727 - DNA, 521 bp, Homo sapiens
  misc_feature: GZ8MTXP01BBPFZ.13.59.F04.1.454.CMB.2.raw
  modified_base (201)..(201): a, c, t, g, unknown or other
  modified_base (215)..(215): a, c, t, g, unknown or other
  modified_base (227)..(227): a, c, t, g, unknown or other
  modified_base (277)..(277): a, c, t, g, unknown or other
  modified_base (291)..(291): a, c, t, g, unknown or other
  modified_base (298)..(298): a, c, t, g, unknown or other
  modified_base (300)..(300): a, c, t, g, unknown or other
  modified_base (309)..(309): a, c, t, g, unknown or other
  modified_base (481)..(481): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatcctcctgtctgcatctcttgganacagagtcaccgtnacgttgccgggnagtcaacgacattaacacttattagcctggtatcagcagaagccaggganagtaccctaaattntgatctntnctgcgtccncttgcaacgtcggggtccatctcggtcaggtggcggtggatcgagacagaatcatctcacatcaaccaactgcacctgaacatgttagggaagtttatacctgtcagtacctatacgtgtcgggccctcgtctaacgttttcgggacgggtacggaccggtaaagtcgacgnacgttaacaaacgtaacctaggtcggcttcggcgtaaccg

SEQ ID NO: 389728 - DNA, 548 bp, Homo sapiens
  misc_feature: GZ8MTXP01A3658.13.59.F04.1.454.CMB.2.raw
  modified_base (202)..(202): a, c, t, g, unknown or other
  modified_base (230)..(230): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtccaccgtcacgttggccgggnagtcacgacattaacacttattagcctggtatcagcagaagccagggagagtaccctaaattattgatctctgctgcgtccgcttgcaacgtcgggggtccatctcggttcaggtggcggtggatcgtaggacagaacttcactctacaccatacaccaactgccaccctgaacgattggttaggggtaaagtttagttactgtactacgaccttagtaaggtcgggtcggcccctcttcgtaagttttcgggcgggacgggttacgaagggtgaccgagttacgtaacaaacgtaacgtggtaggcttggctaaccg

SEQ ID NO: 389729 - DNA, 628 bp, Homo sapiens
  misc_feature: GZ8MTXP01DPF9T.13.59.F04.1.454.CMB.2.raw
  modified_base (233)..(233): a, c, t, g, unknown or other
  modified_base (284)..(284): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctcctgtctgcatctcttggagacagcgtaccaccgttcacgttcggccgggnagtccaacgactattaacacttattagcctggtatcaagcagagcgagganacgtacctaaattactgatctctgtctgcgtccgtcttcgctacgtccggggtactcgtcgtcggttcgagggtcgggtcgggtcgtacgttcgtaaggacgtaagtaaacttcactctaccactactacccaaaccctacctcgaccgaccctagaaagtagttaggttacgggttaaagtttacttaacgttacgtacgtaacgtaacttaggttaacgggtcggtaccggtcccgtctcgttaacggttttcgggacgggtaacggttaaccgtaagggtcgacggttacttaacgtaacgtaaaacgtaacgtcggtcggttacctcgaaccgtaacccg

SEQ ID NO: 389730 - DNA, 628 bp, Homo sapiens
  misc_feature: GZ8MTXP01B3F34.13.59.F04.1.454.CMB.2.raw
  modified_base (495)..(495): a, c, t, g, unknown or other
  modified_base (528)..(528): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatcgacccagtctccatccctccctgtctgcattctcgttggagacagactcaccgtcacgttggccgggcagtcaacgactattaactacttattagcctgtatcagcagaacgcgaggagtacgtacctaaattatagatctctgctcgtccgtccgtccttggactaacccggtccgggggtacctacgtccgtcggttaacgaggttcggggcgggtggaacgtcgtaaggaacgtaagtaaacttcctaccttactaccacctaactacccaaacctaacctcgaccaaccgttagaaagtagttagtagggggtaactttagttacncgttacacgtactagtaggtcggtcgtcccgtnttcgttaacggtttcgggacggggtaacgggttaccgtaagggtcgaaccgagttaacgtaaccgaaaacgtaaccgtgggtcgttacgtcgccgtaacc

SEQ ID NO: 389731 - DNA, 566 bp, Homo sapiens
  misc_feature: GZ8MTXP01ANJPC.13.59.F04.1.454.CMB.2.raw
  modified_base (202)..(202): a, c, t, g, unknown or other
  modified_base (217)..(217): a, c, t, g, unknown or other
  modified_base (230)..(230): a, c, t, g, unknown or other
  modified_base (352)..(352): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagacgtcaccgtnacgttggccgggnagtcaacgacattaactacttattagcctggtatcagcagaagccgaggagagtacctaaattattgatctctgctgcgtccgctgcgtaacgtccggggtccagtcgtcggttcaggtggnggtggatcgaggacagtaactcactctcacactaccaaccgacctgccacctagaaagtagttagttaggggtaaagtttagttaactagtacacgtacctagttacggtcggtcggcccgtcgtcgtaaggtttcgggacgggtaacgggaccgtaagggtgacgagttacgtaaccgaaaccgtaacgttggtacggttctcggccgtaacc

SEQ ID NO: 389732 - DNA, 636 bp, Homo sapiens
  misc_feature: GZ8MTXP01D0T44.13.59.F04.1.454.CMB.2.raw
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagatccggaccgtcacgttggccgggcagtcaacgacattaacacttattagcctggtatcagacagaacgccgagggagacgtacctaaattatgatctctgtctcgtcgtccgcttgacgtaacggtccgggggtcctagtccgttcggttcgtagggtgggtcgggtgggtactcgtagggactaaggtaacttcacttcctacacctactacccaaccctaacctcgaccacccgtagaacgtagttaggttagggtaaagtttattacgttgtactacgtaccttagtacggtcgggtccggtcccgtcgtccgttaaggtttccggggacggggtaacgggaaccgtaaggggttcaacggttacggaaacttaacgaaaaccggtaagttcgggtacggttaccgttaacggaacccgtaaccg

SEQ ID NO: 389733 - DNA, 681 bp, Homo sapiens
  misc_feature: GZ8MTXP01BS4SJ.13.59.F04.1.454.CMB.2.raw
  modified_base (313)..(313): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctcctgtctgcattctcgttaggacacagacgtccaccgtcacgttcggccgggacagtcacgactaacttaacactttattacgcctaggtactcagccgaagacgccgagggactacgtacccttaaattnttagacttctcgtcgtctcgtccgttaccgtctcggactaccggtccggggtaccagtcgttcggtaacgagggtcgggcggtgacgtcgtaaggactagtacttcaccttcactactacttacccgaccctaaccgtcacctaccgagaagtagttacggttaggggtaatttcttaacgtcgtaaccgtagtaacccgtttaggtaacgggtttgggcccggtacccgtcgttacggttaacgggtttccgggggaacgggggtaaaccggttaccggttaaggggtacgaacgaaacgggttaaccttaacccgaaaacgggtcgtttggggaacggttcctttaaccgggaacgtttaaacccg

SEQ ID NO: 389734 - DNA, 653 bp, Homo sapiens
  misc_feature: GZ8MTXP01BFQE2.13.59.F04.1.454.CMB.2.raw
  modified_base (207)..(207): a, c, t, g, unknown or other
  modified_base (243)..(243): a, c, t, g, unknown or other
  modified_base (609)..(609): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtcctgcattctcgttggganacgagacgtccaaccgttcaacgttcgggcccgggngtaacgtccaaaccgtaactaacttaaacctactttaattaacgccgttaggtaactcaacgacgaacggaacggacccggaagggaacgtaacgttaaccccttaaaatttacgtttacgaacttctcgtcgcgttcggtccgttacccgtcttaggaccgtaaccggtccgggggtacctagttccgtcggttaacgaggtcgggcgtgatacgtagactagtaactcactctacaccacaccgaaccacctcacctaccgtagaacgtagttaggttagggtaaacgtttacttacgtaggtacacgtactagtacggtcggtccgcctacgtgtaacgttcggacgggtaacggacgtaggngacgttagacgtaaacgaaccgaattaggcggactcgcgtaacc

SEQ ID NO: 389735 - DNA, 522 bp, Homo sapiens
  misc_feature: GZ8MTXP01EPAA4.13.59.F04.1.454.CMB.2.raw
  modified_base (225)..(225): a, c, t, g, unknown or other
  modified_base (370)..(370): a, c, t, g, unknown or other
  modified_base (389)..(389): a, c, t, g, unknown or other
  modified_base (451)..(451): a, c, t, g, unknown or other
  modified_base (487)..(487): a, c, t, g, unknown or other
  modified_base (510)..(510): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctggagacagagtcacgtcacttggccgggnagtcacgacattaacacttattagcctggtatcagcagaagccagggagagtaccctaaattattagaattctctgcttgcgttcccgcttgctaaacgtccgggggtccagtctcggtcagtggcggtgatctaggacagtatnactctcacatcaccacctncaccctgaacagtgtggggtaagttatactgtcagtacctataggtcggtcggcccgtctcngttttcgggacgggtagggacccgtaaggtcgacgngactaacaaacgaacttgagggnttcggctaaccc

SEQ ID NO: 389736 - DNA, 486 bp, Homo sapiens
  misc_feature: GZ8MTXP01DQTHN.13.59.F04.1.454.CMB.2.raw
  modified_base (226)..(226): a, c, t, g, unknown or other
  modified_base (378)..(378): a, c, t, g, unknown or other
  modified_base (384)..(384): a, c, t, g, unknown or other
  modified_base (459)..(459): a, c, t, g, unknown or other
  modified_base (474)..(474): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacactattagcctggtatcagcagaagcaggagagtccctaaattattgatctctgctgcgtccgccttgcaatcgggggtccatctcggttcagtggcgtggatctaggacagaattcactctcacatcacaaacctncacccngaagatgttggggaattattaactgtcagacctataagtggtgcccgctcaatttcggcggagggaccaaaggtngagatcaaaacgaanagtggctgcaac

SEQ ID NO: 389737 - DNA, 605 bp, Homo sapiens
  misc_feature: GZ8MTXP01APPDB.13.59.F04.1.454.CMB.2.raw
  modified_base (200)..(200): a, c, t, g, unknown or other
  modified_base (294)..(294): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtccaccgtcacttggccgggcagtcaacgacattaacacttattagcctggtatcagcagagcaggagagtacctaaattatgatctntgctgcgtccgcttcgctaaccgtccgggggtccagtctacggttcacggtggcgggtggatcgtagacagtaacttcactctacaccactcaacccaacctcgaccaccctagaaacgtagttaggttaggggttaaagtttaacgtttactaggtacctaacgtaaccgttaagtaacggtcgggtccgggtcccgtcgttcgtaaggttttccgggacggggtaacgggaccgtaaagggtacgacgttaacgttacgttaaccgaaaaccgtaagttacgggtcggacttaacggaaccgtaacccg

SEQ ID NO: 389738 - DNA, 850 bp, Homo sapiens
  misc_feature: GZ8MTXP01B2NQQ.13.59.F04.1.454.CMB.2.raw
  modified_base (189)..(189): a, c, t, g, unknown or other
  modified_base (204)..(204): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtcngctatctcgttgganacagacgtccaccgtcacgttcggccgggacagtccaacgactaattaacgtacttattacgccgtggtatcgacgacgaagaacggaccgaagggaacgacgttaaccccttaaaatttacgttgtaacttccgttctacggtccttcggtccgttcccggtaccgtttcggacccgttaaacggttccccggggggttaccctacgtttcccggttacgggtttaaccgtaacgggttcgggggtaccggggttagggtacgtttaccggtaacgggtaacgtaaacggttaaaacttcctaccttaccttacccaacccctaactaacccctaaacccgtaaacccttacccgaacccgtaaccccgtaacggttaaacgtaacggtttagggtttaaacgggggttaaacgtttttaacgtttaaccgtacggttaacgtaaaccgttaacccgttaaggtttaaaccggggttcggggttcccggtaccccggttacccgtttacggttaaccgggtttttcccgggggaaccgggggtaaccgggttaaacccgggtaccgggtaaggttaccgaaacggttaacgtaaacccggtaaacgtaacggttcgggtacgttaccgtcggaaccgttaacccg

SEQ ID NO: 389739 - DNA, 574 bp, Homo sapiens
  misc_feature: GZ8MTXP01C0KKC.13.59.F04.1.454.CMB.2.raw
  modified_base (234)..(234): a, c, t, g, unknown or other
  modified_base (261)..(261): a, c, t, g, unknown or other
  modified_base (283)..(283): a, c, t, g, unknown or other
  modified_base (297)..(297): a, c, t, g, unknown or other
  modified_base (304)..(304): a, c, t, g, unknown or other
  modified_base (431)..(431): a, c, t, g, unknown or other
  modified_base (502)..(502): a, c, t, g, unknown or other
  modified_base (520)..(520): a, c, t, g, unknown or other
  modified_base (555)..(555): a, c, t, g, unknown or other
  modified_base (560)..(560): a, c, t, g, unknown or other
  modified_base (566)..(566): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgctatctcgtggagacagacgtccaccgtcacgttcggccgggnaagtcaacgacaattaacacttattancctggtatcagcagagcagganacgtacctaaattntgatctntgctcgtcgtccgtacttgccgtaacggtccgggggtacctagtcccgttcggtaccgtaggttcggggcgggtggacgttacgtaggacagtaaactctactactcaacactacaacctaccgtanaccaccgttagaagtagtggttaaggtaagtttacttaacgtgtacacgtactagtacggtgttccggccncgttctaacggtttcggnggtaacggcgaaagggcacgagactaacaaacgtnttggngttacncgctaacg

SEQ ID NO: 389740 - DNA, 601 bp, Homo sapiens
  misc_feature: GZ8MTXP01EUH9N.13.59.F04.1.454.CMB.2.raw
  modified_base (230)..(230): a, c, t, g, unknown or other
  modified_base (267)..(267): a, c, t, g, unknown or other
  modified_base (302)..(302): a, c, t, g, unknown or other
  modified_base (349)..(349): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctcctgtctgcatctcgttggagacagagtcaccgtcacgttcggccgggnagtccacgacaattaacacttattagctggtatcagnagagccgaggagacgtacctaaattctgactctcngtctgcgtccgtctgcgtaacggtcggggtccagtcgtcgttaacgngtggtcgggtgagtcgtaagacgagtaacttcacttcacaccactaccaaacctacctcgaccaccgttagaagtagttagttaggggtaacgtttatacgtcgtacgtacgtacgtaagtggtcggtccggtcccgtcttcggttaacggtttcggggacgggttaaacgggacccgtaagggttacgaccgaagttaacgttaaaccgaaaccggttaacgttggtacggctcggttaacccgttaaccg

SEQ ID NO: 389741 - DNA, 662 bp, Homo sapiens
  misc_feature: GZ8MTXP01BN9ZP.13.59.F04.1.454.CMB.2.raw
  modified_base (217)..(217): a, c, t, g, unknown or other
  modified_base (230)..(230): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtccaccgtnacgttggccgggnagtcacgacattaacacttatttagcctggtatcagcagaacgccgagggagagtaccctaaattacttgatctctgtctgccgttccgtccttgcgtaacggtccgggggtaccagtccgttcggttacgagggtggggccgggtgggtacttacgtaacgggacgtaaggtaaactttacaccttccttaccaaccctaacttacccaaacccctaacccgttcgacccgtaccccgtagaagtacgttaggttacgggggtaaagttttagttaccgtagtacctaacgtaaccgttagttacggtcggtaccggtcccgtcttcgtaacgttttcggggacgggtacgggttaaccgtaagggtcgaccgttagacgttaaccgaaacgtaacgttcgggtaggttaccgttcggaaccgttaacccg

SEQ ID NO: 389742 - DNA, 658 bp, Homo sapiens
  misc_feature: GZ8MTXP01DYVJT.13.59.F04.1.454.CMB.2.raw
  modified_base (196)..(196): a, c, t, g, unknown or other
  modified_base (201)..(201): a, c, t, g, unknown or other
  modified_base (206)..(206): a, c, t, g, unknown or other
  modified_base (213)..(213): a, c, t, g, unknown or other
  modified_base (222)..(222): a, c, t, g, unknown or other
  modified_base (272)..(272): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctntgganacagntcacgtnatggccggnagtcacgactataactacttattagcctgtatcagcaagaagccgagganacgtacctaaattatagatctctgtctcgtcgtccgtctgtaccgtaacggttccgggggtacctagttccgttcggttccgaagggtcgggcggtggtacgttacgagggaaccaaggtaaacttcacctcgtaccaaccacttacccaaccctaaccggtacaccccaaccgaagaagttaacgttacggttaacgggggtaacgttttagttaacctacggttacaacggtacctttaaagtacggttgggttcccgcccgtcgttccgttaacgggtttccggaacgggggttaccgttaaccggaaacggttggaaccaagaccgtaaacgtaaaacccgtaacggttggaaccgggttcgttaacgaaccccgtttaacg

SEQ ID NO: 389743 - DNA, 584 bp, Homo sapiens
  misc_feature: GZ8MTXP01BYX28.13.59.F04.1.454.CMB.2.raw
  modified_base (201)..(201): a, c, t, g, unknown or other
  modified_base (228)..(228): a, c, t, g, unknown or other
  modified_base (280)..(280): a, c, t, g, unknown or other
  modified_base (294)..(294): a, c, t, g, unknown or other
  modified_base (445)..(445): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttggccgggngagtcaacgactattaacacttattagcctggtatcagcagaagccgagganagtaccctaaattntgatctctgctgctccgcttgctacgtccggggtcacgtcgtcggtcgagggtggcgggtggatcgtaggacagtaacttcactctacaccataccaacccacctcgccaacccgtagaacgtagttcggtttagggtaagtttagttacngttacaacgtaccttagtaggtcggtacgcccgtcttcgtcggtttccgggcgggtaacggggaccgtaagggtcgaaccggttagaacgttaaccgaaacgtaacgttcgggtacgggttctaacggaacgtaacccg

SEQ ID NO: 389744 - DNA, 604 bp, Homo sapiens
  misc_feature: GZ8MTXP01BLSJC.13.59.F04.1.454.CMB.2.raw
  modified_base (219)..(219): a, c, t, g, unknown or other
  modified_base (232)..(232): a, c, t, g, unknown or other
  modified_base (325)..(325): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcattctcgttggagacagagtccaccgtnacgttggccgggnatcaacgactacttaaactacttattagcctaggtactcagcagaacgccgaggagacgtacctaaattatgactctctgcgtcgccgttccncttgcgtaaccggtccggggtaccagtcgttcgtacgagggtggcggtggatacgtagacgagtaacttccactcacaccactaccaaccactcaccacctagaacgtattagggttaggggtaaatttacgttacgtacgtacgtaacgttaccgttagttacgggtcggtaccggtccctcgttcggttaacggtttcggggacgggtaacgggaccgttaagggcgacgagttaacgtaaacccgaagtcggtcgtgggacttcgaaccttaaccg

SEQ ID NO: 389745 - DNA, 577 bp, Homo sapiens
  misc_feature: GZ8MTXP01DD1MP.13.59.F04.1.454.CMB.2.raw
  modified_base (195)..(195): a, c, t, g, unknown or other
  modified_base (227)..(227): a, c, t, g, unknown or other
  modified_base (362)..(362): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctnttggagacagagtcaccgtcacgttggccggnagtcacgacattaacacttattagcctggtatcagcagaagcgaggagacgtacctaaattattgatctctgctgccgtccgccttcgacgtaaccggtccgggggtacctagtccgtcggttacgaggtcgggngggtggatcgtaggacagaattcactcacacataccaaccaacctcaccaccgtagaagagttagttagggtaagtttattacctgtacagtaccgtagtagtcggtcgcccgtctcgtgtttcgggacgggaacgggttaccgaaaggggtcgaaccgagttaacgtaacgaaaaccgggtaacttcgggtagggaccttcggttccgtaaccc

SEQ ID NO: 389746 - DNA, 510 bp, Homo sapiens
  misc_feature: GZ8MTXP01BKU5H.13.59.F04.1.454.CMB.2.raw
  modified_base (216)..(216): a, c, t, g, unknown or other
  modified_base (229)..(229): a, c, t, g, unknown or other
  modified_base (288)..(288): a, c, t, g, unknown or other
  modified_base (295)..(295): a, c, t, g, unknown or other
  modified_base (374)..(374): a, c, t, g, unknown or other
  modified_base (387)..(387): a, c, t, g, unknown or other
  modified_base (391)..(391): a, c, t, g, unknown or other
  modified_base (394)..(394): a, c, t, g, unknown or other
  modified_base (407)..(407): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtnacgttggccgggnagtcacgacattaacacttatttagcctggtatcagcagagcaggagagtcctaaattntgatctntgctgcgtccgcttgctaacgtccgggggtccagtcgtcggtacagtggcgtgggatcgtaggacagtaattcacttcncacatcacacgtncacngantgtgggaactttntactgtcagtactatgtgtcgcccgtatcgtaatttcgggcgggaggaccgaaagggtcgacgagttacgtaacgaaacgtaacgtggtcgcgtcgcgtaacg

SEQ ID NO: 389747 - DNA, 622 bp, Homo sapiens
  misc_feature: GZ8MTXP01DWWCX.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttggagacagagtcaccgtcacgttcggccgggcgagtcacgactattaacacttattacgcctggtatcagcagaagccgagggagacgtacctaaattattagattctctgctgccgtccgtcctgacctaacggtccgggggtccagttcctcggttacgaggtgggcgggtgggatacgtaggactagtaacttcactctcacactaccaaccaactcgaccaccctagaagtagttaggtttagggtaaagtttactttacgtcgtactaacgtaccgttagttacggttcggtcggtccccgtcttccgttaaggttttccggggacgggtaacgggttaacccgtaaagggtcgaacgacggttaaacttaaccgaaaaaggtaacgttcgggtcggaccttcggaacccgttaaccg

SEQ ID NO: 389748 - DNA, 646 bp, Homo sapiens
  misc_feature: GZ8MTXP01D86G5.13.59.F04.1.454.CMB.2.raw
  modified_base (216)..(216): a, c, t, g, unknown or other
  modified_base (231)..(231): a, c, t, g, unknown or other
  modified_base (339)..(339): a, c, t, g, unknown or other
  modified_base (622)..(622): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctcctgtctgcatctctggagacagagtccaccgtnacgttcggccggtanagtccaacgaactaattaaactactttaattacgccttaggtatcagacagaagccgaagggagtacgtacctaaagtttacttgactcgttctgtctcgccgttccnctgacctaaccggtccggggtacctagtccgttcgggtaccgagggttcgggacgggtagggtacttacgtaacgggactaagtaaacttccacttcctaccaacactaccaaaccctaacctcgacctaccgagtaaacggtagttacggtttagggggtaaaacttttacgttaacgttacggtaactaacgtaccgttaagtaggtcggtcggccgtcgttcgtaacggtttcgggacggtacgggttacgaaggtcgagacggttaacaacgaaaacgngttacgcggttctaacgctaaccg

SEQ ID NO: 389749 - DNA, 682 bp, Homo sapiens
  misc_feature: GZ8MTXP01CNI0X.13.59.F04.1.454.CMB.2.raw
  modified_base (204)..(204): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatccctccctgtctgctatctcttgganacagacgtccaccgtcacgttcggccgggcgagtcacgacattaactacttattagcctggtatcagcagagcgaggagagtaccctaaattatgatctctgtctgtccgtccgccttgcgtaaccggtccgggggtcctagttccgtcggttcgtaggtgggcgggtggtatcgtaggactagtacttcactcctaccacctactacccaaccctaacctcgaccctaaccccgtagaaacgtacgtttagggtttaacggggttaaaggttttaacgtttaccgttacgttaccgtaaacgtaaccccgtttaaggtaacgggttcggggttacccggccccggttccgttcccggttaacgggttttccgggggaacgggggtaaccggggaaccgtaaacggggtcgaccgttaaggttacctaaccggaaaaccggttaacgtgggtacggttacctcggttcccgtaacccg

SEQ ID NO: 389750 - DNA, 569 bp, Homo sapiens
  misc_feature: GZ8MTXP01D0A1R.13.59.F04.1.454.CMB.2.raw
  modified_base (229)..(229): a, c, t, g, unknown or other
  modified_base (296)..(296): a, c, t, g, unknown or other
  modified_base (366)..(366): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctctggagacagagtccaccgtcacgttggccgggnagtcaacgactattaacattaatttagcctggtatcagcagaagccgagggagagtaccctaaattnttagatctctgctcgcgtccgtactgactaacgtccgggggtcctagtccgtacggttacaggtcggggngggtggaagtcgtaacggactagtaacttccacttctacacccacttaccaacctacctagccacctagaatatggttaggggtaagtttactacgtagtacaacgtacctagtaggtggtacgggtccctctgtaacgtttcgggcgggtaggaccgaggtgacgaggactaacgaaaatcgtaggtcgggctcggctaacc

SEQ ID NO: 389751 - DNA, 562 bp, Homo sapiens
  misc_feature: GZ8MTXP01BZW60.13.59.F04.1.454.CMB.2.raw
  modified_base (217)..(217): a, c, t, g, unknown or other
  modified_base (230)..(230): a, c, t, g, unknown or other
  modified_base (522)..(522): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctcctgtctgcatctcgtggagacagactccaccgtnacgttggccgggnacgtcacgactattaactacttattacgccttggtatcagacagaacgccgagggacacgttacctaaattattagatctctgctgcgtccgcttgctaccggtccggggtcagtccgtcggttacagggtggcggtaggactacgtaggactagtacttcacttcacaccactaccaaccaccgtcacccgacctagaagtagttacggtaggggtaatttacgtactagttacacgtacttagtacggtgtccgtcctctgtaacgtttcgggaggtaacggacgtaggngacgacgttagaactaacgaagttgacgctaagccctaag

SEQ ID NO: 389752 - DNA, 606 bp, Homo sapiens
  misc_feature: GZ8MTXP01EM47C.13.59.F04.1.454.CMB.2.raw
  modified_base (237)..(237): a, c, t, g, unknown or other
  modified_base (292)..(292): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgctatctcgttggagacagtacgtccaccgtcacgttcggccgggnagtcaacgacaattaacacttattagcctggtatcagacagaacgtccgaggganacgtacctaaattatgatctctgctgtccgtccgacttcgaccgtaacggtccgggggtacctagtccgttcggttccagggttgggcgggttgagtcgtaagggacagtactcactctacacactacaaccctactacgccacctagaagtagttaggttagggtaagtttagttacgtacggtactaacgtaccgtagttacggtcggtccggcccgtcgttcggttaaccgttttcggggacgggtacgggaccgtaaggtcgccgaggttactaacgaaacgtcgtaggtcgggactcgaaccgtaaccg

SEQ ID NO: 389753 - DNA, 696 bp, Homo sapiens
  misc_feature: GZ8MTXP01D3GS3.13.59.F04.1.454.CMB.2.raw
tcagtcacgtactacacgaccggtgctcgatttagtacacacacttagggattggggggcagaagtctctctcagtcaggacacagcatggacatgagggtcctcgctcagctcctgggactcctgctgctctggctcccagataccagatgtgacatccagatgaccagtctccatcctccctgtctgcatctcttggagacagacgtccaccgtctacgttcggcccggggtcagtccaacgacattaacacttattagcctggtatcagcagagccgaggagacgtacctaaattattagatctctgctgcgtccgtactggcaacgtccgggggtcctagtccttcggttcaggtcgggcggtagggtactacgtacgggacgtaggtaaacttacctacttcctacacctaacgttaccaaaccccgtaaacctcgaccctaaaccccgttacgaaagttacgttaagggtttaggggttaaacggttttaattttaacccgttaggttaaccaaacgtacccgtttaagttaaacggggttcgggttccgggtccccggcgtttcccgttaaagggttttccgggaccgggggttaacggggaacccgtaaagggttcggaaccgttagttaaacggtaacctaaaaacggtaaccggtttcgggtcggttaccgtcgttaaccgtaacg

SEQ ID NO: 389754 - DNA, 558 bp, Homo sapiens
  misc_feature: GZ8MTXP01A6AA4.13.59.F04.1.454.CMB.2.raw
  modified_base (217)..(217): a, c, t, g, unknown or other
  modified_base (230)..(230): a, c, t, g, unknown or other
  modified_base (298)..(298): a, c, t, g, unknown or other
  modified_base (516)..(516): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctcccagataccagatgtgacatccagatgacccagtctccatccctcctgtctgcatctcttggagacagacgtcaccgtnacgttggccgggnagtcaacgacattaactacttatttagcctggtatcagcaagaagccgagggagagtaccctaaattntagatctctgctgcgtcgcttgctaacgtccggggtccagtcgtcgtcgagtggcggtgatcgtaggacagtaactcactctacacatcacctaactgccacctagaactagttacggttaggggtaatttacttacgtgtaccaaggtacctagtacggtgggtccgccgtacgttctaaggtttccgggacgggtacggaaccgttagggcgacgngttaacgaacaaacgtaaccgttgcggcgtaacttcgtaacc

SEQ ID NO: 389755 - DNA, 613 bp, Homo sapiens
  misc_feature: GZ8MTXP01A7RZW.13.59.F04.1.454.CMB.2.raw
  modified_base (202)..(202): a, c, t, g, unknown or other
  modified_base (232)..(232): a, c, t, g, unknown or other
  modified_base (593)..(593): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagacgtccaccgtcacttggcccggggnagtccaacgactattaactacttattagcctggtatcagcagagccgagggagacgtaccctaaattattgatctcgtgctcggccgtaccgtccttgaccgtaacggtccgggggtcctagtcccgttcgggttcgaggtggggacggtgggtacgtcgtaagggacaggtaacttccaccttactacctaccgactaccctaaccctaaaccctcgcctaaccccgtagaaacgtagttaggttagggggtaaatttattactggtactacacgttactaggtggtccggtcctacgtcgtaagtttcgggagggtaccgggttagaaacgggtgagcgaactaacggaaaccgtaagnggtacgcgtcgccgtaaccg

SEQ ID NO: 389756 - DNA, 555 bp, Homo sapiens
  misc_feature: GZ8MTXP01EJDTJ.13.59.F04.1.454.CMB.2.raw
  modified_base (229)..(229): a, c, t, g, unknown or other
  modified_base (261)..(261): a, c, t, g, unknown or other
  modified_base (278)..(278): a, c, t, g, unknown or other
  modified_base (345)..(345): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacgttggccgggnagtcacgacattaacacttattagcctgctancagcagaagccaggganacgtacctaaatttatgatctctgctgcgtccgcttcgcctacggtcggggtccatccgtcggttcnggtgcggtgatcgaggacagtattcactctacaccataccaccgaactcgaccacccgtagaagtattaggggttaaggtaagtttaacttacgtagtacaacgtacctagttacggtcggcgggtccctcgtcgttacgtttcggggacggacgggtaacccgtaaggttcgacgagaatacgaaaccgtatggcgtaacgttgaaccc

SEQ ID NO: 389757 - DNA, 632 bp, Homo sapiens
  misc_feature: GZ8MTXP01B6BBX.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgacccagtcctccactccctccctgtctgcatctcgttggagacagacgtccaccgtcacgttcggccggcgagtcacgactattaactacttattagctggtatcagcagagccgagggagagtaccctaaattatgtatctctgcgtcgccgtccgtcttgcgtaacgtcccgggggtccagtcgtcggttcgaggtggtcggtggtagtcgtacggactaaggacttcacgtctaccactactacaacccacgtcgaccacccgtagtagtacgttaggttaggggtaaacgtttagtttaccgtgtactacgtaccgttagtacgggtcggtcgggtcccctcggtttcgtaacggttttccgggggaccgggtaacggggttacccgtaaaggggttcgaccgttagttaacggttaaccaaaccggtaacgtcgggttcggacgtcgttaaccgtaacccg

SEQ ID NO: 389758 - DNA, 662 bp, Homo sapiens
  misc_feature: GZ8MTXP01BS5Y7.13.59.F04.1.454.CMB.2.raw
  modified_base (202)..(202): a, c, t, g, unknown or other
  modified_base (332)..(332): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgaccagtctccatcctccctgtctgcatctcttgganacagacgtccaccgttcacgttcggcccgggacgacgtaccaacgaactaacttaaactacttattagcctaggtatcagacagaagccgaggagacgtacctaaattattagatctctgctgcgttccncgttacgctaacgtccgggggtactacgtcgtcggttacgacggtgggtcgggtggtactacgtagacgtaagtaacttcctacttctacaaccctacttaccaacccctaaccttcgaccctaaccctaaggaacgtaagtttaggttaggggtaaactttaacggttactcgttaactaaggtaacccttaggttaacgggtcggtccggtccccggtacttaccggtaacggttttcggggaccgggtaaacgggaaccgtaagggtcgaacgttacgaattaaacccgaaagtaaccgttggacggttactcggaacccgtaaccg

SEQ ID NO: 389759 - DNA, 527 bp, Homo sapiens
  misc_feature: GZ8MTXP01D8HHC.13.59.F04.1.454.CMB.2.raw
  modified_base (216)..(216): a, c, t, g, unknown or other
  modified_base (228)..(228): a, c, t, g, unknown or other
  modified_base (299)..(299): a, c, t, g, unknown or other
  modified_base (358)..(358): a, c, t, g, unknown or other
  modified_base (386)..(386): a, c, t, g, unknown or other
  modified_base (471)..(471): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtnacttggccgggnagtcacgacattaacacttattagcctggtatcagcagaagccgaggagagtaccctaaattattgatctntgtctgcgtcctcttgctaacgtcgggggtccatcgtcggtcagtggcgtgatctaganagtaatcactctcacatacaccacctcncaccctagaagtatgttaggggtaatttagttacctgttacagtaccttagtacggtggtccggccgtctcgtaagttttcgggngggtacgggaccgtaagggtgacgagactaacgaaacaacgttgagctcgctaacc

SEQ ID NO: 389760 - DNA, 675 bp, Homo sapiens
  misc_feature: GZ8MTXP01DNP5W.13.59.F04.1.454.CMB.2.raw
  modified_base (204)..(204): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcgtggaanacagagtccaccgtcacgttcggccgggcagtcacgactaacttaactacttattagcctaggtactcagacagaacgaccgagggacacgtacctaaattatagtatctctgtcgtcgtccgttccgtcttgaccgtaacggttcccgggggtacctagttcccgtcggttacgacgggttcggggtacggtgggtagtcgtaacgggaactaagtaactactaccttcctaccaactaacttacccaaacccgtaaccttcgacccctacccgtaggaaacgtagtttagggttaacggtaagttttaacttactacggtactaacgtacgtaagttcggtcggtccggtccgtcttcgttaacggtttcgggacgggtaacgggaccgttaaagggcgaacgacgttaacgtaaccggtaaaaccgtaaggttcggtccgggttactaaccggttaacgttaaccccg

SEQ ID NO: 389761 - DNA, 693 bp, Homo sapiens
  misc_feature: GZ8MTXP01BWS0B.13.59.F04.1.454.CMB.2.raw
  modified_base (205)..(205): a, c, t, g, unknown or other
  modified_base (509)..(509): a, c, t, g, unknown or other
  modified_base (607)..(607): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatcgacccagtctccatccctccctgtctgcatctcgttgganacagtacgtccaccgtcacgtcggccgggacagtacacgactaattaactacttattagcctaggtatcgagcgaagaacggccgaagggacgtacgtaaccctttaaattacttagtaactcttacgtcgtcgtccgtccgttaccccgtcgttcgaccggtaaccccggttcccgggggtaacctcgttccggttccggggttaacgtacgggttcggggtacgggttgggtaacttcggtaaaggaccgtaaaggtaaaccttcctacttcctacccacctaactacccaaccccgtaacncgacccgaacccgttagaaagttacgtttggtttaaggggttaactttagttacgtcgtaacgtaacgtaaccttagacggttcggtaccggcccgtnttcgtcggtttcgggacgggtacgaccgtaggtcgacgttaggactaacgtaaacggtcgttggacggttcctaacggccccttaa

SEQ ID NO: 389762 - DNA, 529 bp, Homo sapiens
  misc_feature: GZ8MTXP01BDPZ5.13.59.F04.1.454.CMB.2.raw
  modified_base (202)..(202): a, c, t, g, unknown or other
  modified_base (461)..(461): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtccaccgtcacgttcggccgggcagtccacgacattaacacttattagcctggtatcagcagaagccgagggagacgtaccctaaattatgatctactgctgccgtccgcttgactaacgtcggggtccagtctcggtacagtggcgtgatcgtagacagacttcactctacacactcaaccactcgacctaccagaatagtggttaggtaagtttatactgtacagaccttaagtcggtggtacggtccctntcgtaagtttcgggcgggtacggaccgtaaggtcgacgagataacgaaacgtaatcgtggctgcgaac

SEQ ID NO: 389763 - DNA, 655 bp, Homo sapiens
  misc_feature: GZ8MTXP01DT5V6.13.59.F04.1.454.CMB.2.raw
  modified_base (203)..(203): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctccctgtctgcatctcttgganacagagtccaccgtcacgttcggccgggcgaagtccaacgacaattaactacttattagcctggtatcagcagaacgcaggagagtacctaattatgtatctctgctcgcgtccgtctgctaacgtcggggtcctagtccgtcggttacgaggtgggcggtaggacttacgtagggactaagtacttactacctactaccacctactacccaaaccaaccctacgaccctacccgtagaagtattaggttagggttaaaggtttaattacttacgtactaacgtaccgttaagttaaggttcgggtccggttcccggtaccgttcggtaacggttttccggggaccgggggttaaccggggaacggtaaacgggtcgttaaccggttaggttaaaccgtaaccgtaaaaccgtaaccgttgggtccgggttacgttcggaacccgtaacccg

SEQ ID NO: 389764 - DNA, 543 bp, Homo sapiens
  misc_feature: GZ8MTXP01AYE9R.13.59.F04.1.454.CMB.2.raw
  modified_base (201)..(201): a, c, t, g, unknown or other
  modified_base (438)..(438): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttatttagcctggtatcagcagaagccagggagagtcccctaaagttattgaatctctgctgcgtccgccttgcgaactccgggggtccatctcggttcaggtggcgggtggatctagggacagaattcactctacaccatcaccaaacctgccaccctagaagagtgttaggggtaagtttattaactgttacngtacctagtagtggttgggcccgtctcaagttttcgggacgggtaggggaccgtaaagggtgcgaggattaacccgaaagaacctggtgggcttggcgtaacccg

SEQ ID NO: 389765 - DNA, 540 bp, Homo sapiens
  misc_feature: GZ8MTXP01BEZ1N.13.59.F04.1.454.CMB.2.raw
  modified_base (218)..(218): a, c, t, g, unknown or other
  modified_base (232)..(232): a, c, t, g, unknown or other
  modified_base (267)..(267): a, c, t, g, unknown or other
  modified_base (270)..(270): a, c, t, g, unknown or other
  modified_base (282)..(282): a, c, t, g, unknown or other
  modified_base (294)..(294): a, c, t, g, unknown or other
  modified_base (511)..(511): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatcgacccagtctccatcctcctgtctgcatctcgttggagacagagtccaccgtnacgttcggccggtnagtcaacgactattaactacttattagctagtatnagnagaacgcagganagtacctaaatntagatcgtctgctgtccgtccgcgttgactaacggtccgggtaccagttcgtcggtacagggtggcgggtagtactacgtaggacagtaactcactctacacactaccgaaccactcgacaccgtagaagattggttagggtaatttatacgtcgactagtaacctgtaacggtggtccgcctgtcgtaagttccgggaggtacggacgaggtcagngacaagaacgtgtcgagctcgttctaacg

SEQ ID NO: 389766 - DNA, 619 bp, Homo sapiens
  misc_feature: GZ8MTXP01EZGZ6.13.59.F04.1.454.CMB.2.raw
  modified_base (201)..(201): a, c, t, g, unknown or other
  modified_base (215)..(215): a, c, t, g, unknown or other
  modified_base (228)..(228): a, c, t, g, unknown or other
  modified_base (295)..(295): a, c, t, g, unknown or other
  modified_base (297)..(297): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctgactcccagataccagatgtgacatccagatgacccagtctccatcctccctgactgcatctcttgganacagagtcaccgtnacgttggccgggnagtcacgacaattaacacttaattagcctggtaatcagcagaagccaggagacgtacctaaaatttntntatctcgtgctcgccgtcgtctgacgtaccggtcggactctcgtcgtacgtagtggtcggtaggtagtacgtaaggtacgataactactctactacactacctacctaaccaaccgtacgaccgacctacgtaagtagttaggttagggttaaacgtttaaacgtttactacgtacgtaacgtaacgttacgttagggtcggtcggtcccgtccgttagttaacggtttcggggttacggggaacgggttaacggtaacggtacgacgaacgttaacgtaacgtaaacgtaacgtaacggtacggttacgtcgttcgtaacg

SEQ ID NO: 389767 - DNA, 622 bp, Homo sapiens
  misc_feature: GZ8MTXP01B40N5.13.59.F04.1.454.CMB.2.raw
  modified_base (207)..(207): a, c, t, g, unknown or other
  modified_base (223)..(223): a, c, t, g, unknown or other
  modified_base (239)..(239): a, c, t, g, unknown or other
  modified_base (299)..(299): a, c, t, g, unknown or other
  modified_base (312)..(312): a, c, t, g, unknown or other
  modified_base (320)..(320): a, c, t, g, unknown or other
  modified_base (375)..(375): a, c, t, g, unknown or other
  modified_base (429)..(429): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctccagataccagatgtgacatccagatcgacccagtctccactccctcctgtctgctattctcgttggaanacagacgtccaccgtnacgttcgggccggganacgtaccaacgaactaattaaactacttattagcctaggtactcagcagaacgcgagganacgtacctaaatnttgatctntgctcgcgtccgtcgttgcctaacggtccggggtctagttcgtccggttaagggngggtcggtcgtgtactacgtagactatactcactacacactacaccaccgtacncacacgtagtaagtagttagttaggttaactttagtacgtacgtactacgtacgttagttacggtcggtccgtaccgttacgttacggttaacgggttaccggggacgggtaacggttaaccggtaacggtcgaacgaaggttaaacctaaacgtaaacgtcgtcggtacgttaccgtaaccgttaacgtccg

SEQ ID NO: 389768 - DNA, 616 bp, Homo sapiens
  misc_feature: GZ8MTXP01AJMZR.13.59.F04.1.454.CMB.2.raw
  modified_base (286)..(286): a, c, t, g, unknown or other
  modified_base (318)..(318): a, c, t, g, unknown or other
  modified_base (416)..(416): a, c, t, g, unknown or other
  modified_base (435)..(435): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcgttggagacagacgtccaccgtcacgttcggccgggcgagtcaacgactattaacacttattagcctggtatcagcagagccgtaggganacgtacctaaattatgatctctgctgcgtccncttgctaacgtccgggggtccatcgtcggttcacgttggcgggtgatcgtaggacagaaactttcacttcacaacctactaccaaccctaaaccggtnacccacccgttagaaagtnttagggttagggtaagtttacttactacggttacaaggtacccttaaagttacgggtcggttccggaaccccgtcgttcgtaacgttttcgggacggggttacggacccgttaaagggtcgagacgttacgtaaccgaaaaacgtccgttgggtcccggttacgtaaccgttccgtaaccg

SEQ ID NO: 389769 - DNA, 665 bp, Homo sapiens
  misc_feature: GZ8MTXP01DGCMP.13.59.F04.1.454.CMB.2.raw
  modified_base (205)..(205): a, c, t, g, unknown or other
  modified_base (236)..(236): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccactcctccctgtctgcatctcgttggaanacagacgtccaccgtctacgtcggccggganagtcaacgacaacttaactacttattacgcctaggtatcagacagaacgcgtaggagtacgtacctaaattatagtatctgtcgtctcggccgttccgtacctttggaccgtaaaccggttccgggggtacctacgttccgtacggttccgagggttcgggcgggtggtaactcgtaaggacagtaactcactctacacctacaccaaccgaactcaccgaccgtagaagtattacggttaaggggttaatttaaccgttatagtacgtaacgtaacgtagttacgggtgtccgggtccctcgttacggttccggtttacggggacggggaaacgggttaccgtaaacgggggtaacgttaacggttaaacgttaacgtaaaccggtaaacggtaacggttcggcggttaccgtaaccgaaccgttaac

SEQ ID NO: 389770 - DNA, 569 bp, Homo sapiens
  misc_feature: GZ8MTXP01DQU8I.13.59.F04.1.454.CMB.2.raw
  modified_base (201)..(201): a, c, t, g, unknown or other
  modified_base (228)..(228): a, c, t, g, unknown or other
  modified_base (303)..(303): a, c, t, g, unknown or other
  modified_base (315)..(315): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctcctgtctgcatctcttgganacagagtccaccgtcacgttggccggnagtcacgacattaacacttattacgcctggtatcagacagaagccgaggaagacgtacctaaattatagatctcngtctgtcgtccncttgacgtacgtccggggtctacgtctcggttcgagtgggcggtagatcgtaaggactagtaacttcacttcacacactacaaccactcgacctacagaatagtagttaggggtaaattattactagtacgtacgtaaccgtagtaacggtcggtacgtccccgtgtcgtaacggtttcggaccggggtaaagaccgtaaggcgagacgaacgttaaccgaaacgtaaccgttgacggcttcgaaccgtaaccg

SEQ ID NO: 389771 - DNA, 601 bp, Homo sapiens
  misc_feature: GZ8MTXP01EH45V.13.59.F04.1.454.CMB.2.raw
  modified_base (236)..(236): a, c, t, g, unknown or other
  modified_base (431)..(431): a, c, t, g, unknown or other
  modified_base (451)..(451): a, c, t, g, unknown or other
tcagtcacgtactacacgaccggtgctcgatttagtacacacacttagggattggggggcagaagtctctctcagtcaggacacagcatggacatggagggtccctgctcagctcctgggactcctgctgctctggctcccagataccagatgtgacatccagatcgacccagtcctccatccctcctgtctgcatctcgttggagacagacgtccaccgtctacgttggccgggnagtccaacgactaacttaactacttatttacgccttaggtatcgaagacaagaagccgaagggagtaacgtacctaaagttcttgattctctgctgccgtcgcttgctacggtcgggtccagtcgtcggtacagggtggcggtgtatcgtaaggacagtacttcactctacacatacccaacgaactcacaccanagtattgtagggtaactttntacgtgtacaggtaccttaggtacgttcgggaccgtcccgtcgttcgttaacgggtttcggggacgggtaaacgggttaaccgttaagggtccgaacgagttaacggtaacaaacggtaaccgttggacgcggttcgaaccgtttaaccg

SEQ ID NO: 389772 - DNA, 661 bp, Homo sapiens
  misc_feature: GZ8MTXP01BWZVR.13.59.F04.1.454.CMB.2.raw
  modified_base (231)..(231): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatcgacccagtctccatccctcctgtctgctatctcgtggagacagacgtccaccgtcacgttggccgggnagtcacgactattaactacttattagcctggtatcagacaaggaagccgagggagtacgtaacccttaaagttatgtattctctcgtcgtcgtccgtccgtcgttacgcgtaaccggtccgggggtcctagttccgttcggttaacgagggtcgggtcgggtaggtacgttacgtaagggtaactaaggtaaactttccacttcctaccaacctacttacccaaaccctaaaccgtcgaccctaacccgtaagtaacgttagttaggtttaacggggttaacggttttaacttacgtacgtacgtaacgtacgttagttacggtcggtaccggccgtcgttcgttaacggtttcggggacggggaacggttacggtacggtgttacgacgagtaacgtaacgaacgttcggtacgcgttcgccgtaaccg

SEQ ID NO: 389773 - DNA, 625 bp, Homo sapiens
  misc_feature: GZ8MTXP01ACUU5.13.59.F04.1.454.CMB.2.raw
  modified_base (206)..(206): a, c, t, g, unknown or other
  modified_base (234)..(234): a, c, t, g, unknown or other
  modified_base (304)..(304): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccactccctccctgtctgctatctcgttgganacagagtccaccgtcacgttggccgggngagtccacgacattaactacttattagcctggtatcagacagaacgcgagggagacgttaccctaaattntgattctactgtctgccgtccgtcttcgacgtaaccggtccgggggtacctagttccgtcggttcgaggtggcgggtgtagtcgtaggacagtaactcactctcacactacaaccacctcgacctacccgtagaagtagttaggttaggggttaaagtttctttacgtacgttaccgaagtaccgttaagtacgggtcggttaccggtcccgtccttcggttaacggtttaccgggcgggttaaacggggacgtaacggtcgacgacgttaaactaaccgaaaagtaaccgttggtcggttaccgtgaacccgttaacccg

SEQ ID NO: 389774 - DNA, 574 bp, Homo sapiens
  misc_feature: GZ8MTXP01BTWB0.13.59.F04.1.454.CMB.2.raw
  modified_base (204)..(204): a, c, t, g, unknown or other
  modified_base (293)..(293): a, c, t, g, unknown or other
  modified_base (307)..(307): a, c, t, g, unknown or other
  modified_base (309)..(309): a, c, t, g, unknown or other
  modified_base (358)..(358): a, c, t, g, unknown or other
  modified_base (377)..(377): a, c, t, g, unknown or other
  modified_base (544)..(544): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcgttgganacagacgtccaccgtcacgttcggccgggatagtccaacgactacttaacactttattagcctaggtatcaagcagaacgtccgagganacgtacctaaattntnatctctgctgcgtcgtctgactacgtcgggtcagtctggtacaggtggngtgatcgagacatacttcnctcacacatacctaaaccactacgaccaccgttagaagtagttcgttaaggggtaatttatactgttacacgttacctagttacggtcggtccgccgtacttcgtaacgggttttacgggcgggtaacggaccgtagggttcgaccgttagggttacaacggtaaanaaccgttggacgggctaacggccttaaccg

SEQ ID NO: 389775 - DNA, 720 bp, Homo sapiens
  misc_feature: GZ8MTXP01DE30L.13.59.F04.1.454.CMB.2.raw
  modified_base (238)..(238): a, c, t, g, unknown or other
tcagtcacgtactacacgaccggtgctcgatttagtacacacacttagggattggggggcagaagtctctctcagtcaggacacagcatggaaatgagggtccctgctcagctcctgggactcctgctgctctggctcccagactaccagatgtgacatccagatcgacccagtctccatccctcctgtctgctatcctgtaggagacagacgtccaccgtctacgtgggcccgggtnagtcaacgtactaacttaacctactttaagttacgcctaggtactcgaagaccgaagtaacggccggtaagggtaacgtaacgttaacccttaaaatttcgttacgtacttccgttcgtacgtcccgttacggtccccggttccgtcccgttaggacccgtaaccgggtttcccccgggggtaccccttagttcccggtacggttacgagggttcgggtcggggttagtaacgttacgtaacggactaagtacttccacttcgaccacgactaccgacctaacgtcaccacgtagaagttagtacgtttaaggtaatttcttacgtacgtacgtaacgtaccgtaagttcggggtcgttcccgtccgtacttccggtacgggtttcgggaacgggaacgggaacgttaggtacggaccttaagggttaaccttaaacggtaacgtacggtgtccggacttaacgcccgttaacgtttaaccg

SEQ ID NO: 389776 - DNA, 609 bp, Homo sapiens
  misc_feature: GZ8MTXP01EP1HC.13.59.F04.1.454.CMB.2.raw
  modified_base (206)..(206): a, c, t, g, unknown or other
  modified_base (235)..(235): a, c, t, g, unknown or other
  modified_base (283)..(283): a, c, t, g, unknown or other
  modified_base (304)..(304): a, c, t, g, unknown or other
  modified_base (314)..(314): a, c, t, g, unknown or other
  modified_base (361)..(361): a, c, t, g, unknown or other
  modified_base (375)..(375): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctcccagataccagatgtgacatccagatcgacccagtcctccatccctccctgtcctgcatctcttgganacagacgtcaccgtcacgttcggccgggnagtcacgacattaacacttattagcctggtatcagcagagccgagganacgtacctaaattatgatctntgctgcgtcnctgctaccgtcggggtcatcgtcgtacagtggcgtgatcgtaagganagtaattcacttcncactacacaaccgtaacctcgactaccctagaagtatagggtttaggggtaaattttacgttactacggttacaacgtaccgtttaagtacgggttcggtccgggtacccttcgttaaccgttggttttaccggggacggggtaacggggttaaacccgtaagggtacgaccgaaggaacttaacccggaaaaagtaaccggtttgggtacggcgttaacggaacccgttaacg

SEQ ID NO: 389777 - DNA, 485 bp, Homo sapiens
  misc_feature: GZ8MTXP01BV36O.13.59.F04.1.454.CMB.2.raw
  modified_base (265)..(265): a, c, t, g, unknown or other
  modified_base (366)..(366): a, c, t, g, unknown or other
  modified_base (373)..(373): a, c, t, g, unknown or other
  modified_base (387)..(387): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaaccgtcacttgccgggcgagtcacgacattaacacttattaagcctggtatcancagaagccaggagagtcctaaatattgatctctgctgcgtccgcttgctaactcgggggtccatctcggtcaagtggcggtgggatctagacagaatcacntcacatnaccactgcaccctnaagatgtggagttatactgtcagaccatagtgtgccgctcaatttggcggtagggacgaaagggtgcgagagtaacaaaagaactagtggctgcaacc

SEQ ID NO: 389778 - DNA, 638 bp, Homo sapiens
  misc_feature: GZ8MTXP01EHGCI.13.59.F04.1.454.CMB.2.raw
  modified_base (201)..(201): a, c, t, g, unknown or other
  modified_base (204)..(204): a, c, t, g, unknown or other
  modified_base (227)..(227): a, c, t, g, unknown or other
  modified_base (266)..(266): a, c, t, g, unknown or other
  modified_base (271)..(271): a, c, t, g, unknown or other
  modified_base (298)..(298): a, c, t, g, unknown or other
  modified_base (304)..(304): a, c, t, g, unknown or other
  modified_base (440)..(440): a, c, t, g, unknown or other
tcagtcacgtactacacgaccggtgctcgatttagtacacacacttagggattgggggcagaagtctctctcagtcaggacacagcatggacatgagggtccctgctcagttcctgggactcctgctgctctggctcccagataccagatgtgacatccagatgacccagtcctccatcctccctgtctgcatctctgganacngatcaccgtcacgttgccgggtnagtcaacgtacattaaacctattattaagcctggtaacncaganagacgacgaggagacgtactaattgtntatctntgtctcgccgtccgtctcgacgtacggtccccgggtcctagtcgtcggttcgtaagggtcgggtcggttagtacgtacgtacgtaacgtaacgtaactacctacctactacacctaactaaccctaaccctaaccncgtaccctacgtagtaagtagttagttaacggttaagtttacttacgtagtacgtaacgtacgtagttcggtcggtccgtaccgtacgttcgttacgggttaacgggacgggttacggtaacggttaacggtcgtacgttaacgttacgttaacgtaacgtacgtaacgtcggtcgttacgtaaccgttaacgtaacg

SEQ ID NO: 389779 - DNA, 693 bp, Homo sapiens
  misc_feature: GZ8MTXP01AGUXC.13.59.F04.1.454.CMB.2.raw
  modified_base (209)..(209): a, c, t, g, unknown or other
  modified_base (280)..(280): a, c, t, g, unknown or other
  modified_base (309)..(309): a, c, t, g, unknown or other
  modified_base (318)..(318): a, c, t, g, unknown or other
  modified_base (325)..(325): a, c, t, g, unknown or other
  modified_base (456)..(456): a, c, t, g, unknown or other
tcagtcacgtactacacgaccggtgctcgatttagtacacacacttagggattgggggcagaagtctctctcagtcaggacacagcatggacatgagggtccctgctcagctcctgggacctcctgctgctctggctcccagactaccagatgtgacatccagatcgacccagtcctccactccctcctgtctgctatctcgttagganacagtacgtccaccgtctacgttcgggccgggtacgagtcgagggctaattaagaatgtagtgctaggtancagacaacgaaacgaggaaacgccctaanctctgactntagtganactagttaacgtaaaggttaaacggtcggtaacccctagtacgtaaggtaccggacgtaacgggacgtaagggttacggacgttcggacggtacaacgtacgttacttactacgttacccaccgtaaaccngtaccgaacgtcctaaccgtccgtagaccgtacggtaccgtaagtaaacggtttactttacaccttaaactttacttacgtacctaataaaccgtaatactaaacctaacgttaacgttccggtacgggttacgggtaccgttaccgggaaaccggtaaagggttaaacccgaagggggttaaactaaaccgtaacgaaacggttccgtaggggttaccgtaaccttcggtaacccc

SEQ ID NO: 389780 - DNA, 633 bp, Homo sapiens
  misc_feature: GZ8MTXP01DFTS9.13.59.F04.1.454.CMB.2.raw
  modified_base (203)..(203): a, c, t, g, unknown or other
  modified_base (231)..(231): a, c, t, g, unknown or other
  modified_base (362)..(362): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgctatctcgttgganacagtactcaccgtcacgttggccgggnagtcaacgactattaactacttattagccgtggtactcagcagaacgcgaagggagacgtacctaaattactgatctcgtgctcgtcgtcctctgacgtaacggtccggggtcctagttcctcgttaacgngtgggcgtgatgacgacagtaactctacgtcacactactaccacctaacgtcaccacctaggaatagttagttaagggggttaagtttacgttaaactcgtaacggtaacttaacccgttaggtaacggtcggtcccgtacccggtccgtttacggttaacggttttcgggaccggggtaaacggaacccgaaagggttcgaacccgttaagggaaccttaaaccgaaacggtaaccgtttgggcggttacttaacggaaccccgttaacg

SEQ ID NO: 389781 - DNA, 603 bp, Homo sapiens
  misc_feature: GZ8MTXP01A3AL3.13.59.F04.1.454.CMB.2.raw
  modified_base (289)..(289): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctccctgtctgcattctcgttggagacagacgtccaccgtcacgttcggccgggcagtcaacgactattaacacttattagcctggtatcgagcagaacgccgaggganacgtacctaattatgactctactgtctgtccgtccgtcttacgacgtaacggtccggggtcctagttccgtcggtacgagggtgggcggtgatcgtaggacaagtacttccactctacgaccactaccaacccgaacttcgaccctaccgtagaaacgtgttaggttaggtaaacggtttattacgtagtaactacgtaacttagtacggtcggtaccgtcccgttacgtcgttaacggttcgggacgggtacggacgtaggtccgagttagacgtaacgaaccgtaagttcgggcgttactcggcgtaacccg

SEQ ID NO: 389782 - DNA, 649 bp, Homo sapiens
  misc_feature: GZ8MTXP01EMJDM.13.59.F04.1.454.CMB.2.raw
  modified_base (201)..(201): a, c, t, g, unknown or other
  modified_base (231)..(231): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctcctgtcctgcatctctgganactagacgtccaccgtcacgttggccgggnagtcacgactattaactacttattagcctggtatcgagcaagaagccgagggagacgttaccctaaattacttagtatctctgctcgcgtccgtcttgcgtaacgtccggggtaccagtcgtcgtcgaggtcggcggtgactgtagactagtaacttcactctacacactcaaccctaaccgtcaccaccctaggtaaacgtacgttaggtttaacgggggtaaattttaacgttttacgtacgttaaccgtacgtaaaccgtttagttaaacgggttcgggtaccgggtccccgttccgttacggttaaacggtttttccggggaacggggttaaaccggggaaccgtaacggggtagacccgttaaggttaactaaccgtaaacgtaacgttggtcgggacttaacgcttaacccg

SEQ ID NO: 389783 - DNA, 659 bp, Homo sapiens
  misc_feature: GZ8MTXP01AHX4A.13.59.F04.1.454.CMB.2.raw
  modified_base (205)..(205): a, c, t, g, unknown or other
  modified_base (234)..(234): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgcatctcgttgganacagactccaccgtcacgttcgggccggngagtccaacgactacttaactacttattacgcctaggtatcagcagacgccgagggagtacgtaccttaaattatagtactctctgcgtcgcgttccgtcgttacgacgtaaccggtccgggggtccacgttcgttcggtacgtaggtcgggcggtaggatacgtagacagtactcactctacactacacaacctaactcgaccaccgtagaagtagttaggttaggggttaaagtttattaaccgtagtactaaacgtacgttaagtacggttcggccggcccgtaccgttcggttaaggtttcccgggggacgggggtaaacggaaaccccggtaacggggttaacgaaccggttaacgttaaacgtaaacccggtaaacggtaacggttacgggtacggttaccgtaacgaacccgtaaccg

SEQ ID NO: 389784 - DNA, 610 bp, Homo sapiens
  misc_feature: GZ8MTXP01EMKBU.13.59.F04.1.454.CMB.2.raw
  modified_base (203)..(203): a, c, t, g, unknown or other
  modified_base (230)..(230): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatcgacccagtctccatcctccctgtctgcatctcttgganacagagtcaccgtcacgttggccgggngagtcaacgacaattaacacttattagcctggtatcagcagaagccgaggagagtaccctaaattatagatctactgctgccgttccgcttgcgaaccgtcgggggtcctagtctcggttacaggtggcggtgggatacgtaggacagacttcactcacaccatacaacctaacctacgaccaccctagaatagttagttaggggtaagtttattacgtggtacctaacgtaccgtaagttaacggtggtcggtccccgtcttcgttaaccggttttcggggacggggtaaacgggttaaccgtaaaggggttcgaccgaaggttaaccgttaacaaaacggtaaacgtggttacggggccttaacgaaccgttaacccg

SEQ ID NO: 389785 - DNA, 762 bp, Homo sapiens
  misc_feature: GZ8MTXP01D97U0.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccactcctcctgtctgctatctcgttggacgacagacgtccaaccgttctaccgttcgggcccggggacacggtcaaacgactaacttaaactacttattagacctaggtactcaagacaagaacgaccgaagggaagtaacgttaacccttaaaattattacggtaattccttcgtcggtcttcggtccggttcccgtccgttcgtaccgtaaccgggttcccgggggtacctacgtttccgttccggggtttaacgtacgggttcggggtccggttagggtacgttacgttaaacggggaacgaaggtttaaacttcccgtaacctccttaccaaccttaacgaaccctaaacccgtaaacccttcggaccctaaccgaagaaacgttagttaggtttaacgggggttaaattttacgttaacgttacggtacgtaacgtacccgttaaggtaccgggttcggtccggtcccgtacttcggttaacggtttcgggacgggtacggggttaacgaacgggtcgacgagttaacgttaacggaaaaacgttccggttaggcggggttaccaaccggaacttaacccg

SEQ ID NO: 389786 - DNA, 669 bp, Homo sapiens
  misc_feature: GZ8MTXP01AXRP7.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccattccctccctgtctgctattctcgttggacgacagtacgtccaccgtctacgttcgggccgggagtacgtacacgtaactaacttaaactacttaattcgcttaggtatcgaggacaagaaggtccggaagggtaactaacgttacccttaaatttagtagacttcttcgtagtccgtacgtcccggttccgtccgtaggacctaaccggggtcccggggtcctagttccgttcggttacgagggttcggcggttagacgttcgtaggactagtactctactccactaccactaccaacctaacctcgaccaccgtagtaaacgtgtttaggttaacggggtaagttacttacgtgtaaccgtagtaccgttagtcgggtccggtccggtcccttcgtccgttaacgggtttacggggcggggtaccggttaacgaggtaaccgacgaaggaccttaaacggacgaacgtagggtcgcgtcgttctaaccg

SEQ ID NO: 389787 - DNA, 648 bp, Homo sapiens
  misc_feature: GZ8MTXP01DZHN9.13.59.F04.1.454.CMB.2.raw
  modified_base (204)..(204): a, c, t, g, unknown or other
  modified_base (235)..(235): a, c, t, g, unknown or other
  modified_base (314)..(314): a, c, t, g, unknown or other
  modified_base (399)..(399): a, c, t, g, unknown or other
  modified_base (613)..(613): a, c, t, g, unknown or other
  modified_base (637)..(637): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgcatctcttgganacagacgtccaccgtcacgttcggccggggnacgtcaacgactaacttaacactttacttagcctggtactcgagcaagagccgagggaacacgtacctaaatttagttnacttctcgtgtcgtcgtacgttcccgtcgtacggacgtaaccggtccggggtcctaagttccgttccggttaacgtaggtcgggngggtacgtacgtacgtaacgggtactaaggtacttactacctacttaccaacctaacttaccaaacccggtaaaccttcgaccctaccgttaagaagttacgttaggtttagggggtaaactttattaccgtaggtacctaaagtaccttaggttaacgtcgggtccgtccgtcctaggtaacgtttcgggacggtacgggttacgacgggtanacgttagactaacgaagtcgtggngctcgaacgtc

SEQ ID NO: 389788 - DNA, 727 bp, Homo sapiens
  misc_feature: GZ8MTXP01CR8VV.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccactccctccctgtctagctacttcttcgtagggaacgactaggtacgtccctaaccgtctaaccgttcgggacccgggataacgtaccgaaaccgtaactaactttaaacctacttttaacgttacgaccgttaggtaactaccgaagacgaaaggaacgtaccggaagggaacgtacgttaaaccctttaaaatttagtttactaacttccgttcgtacgtcgtcggtacccgttcccgtacgtttacggaccgtaaccggttccccgggggtacctacgtttaccggtccggttaacgtacgggtcgggtacggtacgtacgtacgtaggaactagtaacctctactacctacactactacaacctaccacgtaccaccgtagtaagtagttacgttaaggttaagttaagttcgtagacgtaacgtacgtagttacggtcgtaccgtccgtacgttcgttaaccggttcggggaacggttaacggaccggtagcgaccgttagttaaccgaacgtaaacgtcgtggtcgacgtaacgaactaacccg

SEQ ID NO: 389789 - DNA, 686 bp, Homo sapiens
  misc_feature: GZ8MTXP01CIERQ.13.59.F04.1.454.CMB.2.raw
  modified_base (202)..(202): a, c, t, g, unknown or other
  modified_base (216)..(216): a, c, t, g, unknown or other
  modified_base (230)..(230): a, c, t, g, unknown or other
  modified_base (283)..(283): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagcgtcaccgtnacgttcggccgggngagtcaacgactattaacacttattagcctggtatcagcagaagccgaggganacgtacctaaattatgattctactcgctcgcgtccgtacttcggcgtaaccgtccgggggtacctagtccgttcggttacgtacgggtcgggcgggtaggtacgtacgtagggactaaggtaacttaccacttcctaccacccacttacccaaaccctaacccgttacgaccgtacccgtaagtaacgtagttacggtttaagggggtaaacgttttaacgttaacgttacggtacgtaacgttaacccgttaaggtttacgggtacgggttccgggtccccggttcgttacgttaacggtttttaccggggacggggtaacggggaaccgtaaagggtcggacgaacgttaacgtaaccgaaaggtaaccgttgggacggttacgtcggttaaccgtaaccg

SEQ ID NO: 389790 - DNA, 622 bp, Homo sapiens
  misc_feature: GZ8MTXP01EH9EA.13.59.F04.1.454.CMB.2.raw
  modified_base (231)..(231): a, c, t, g, unknown or other
  modified_base (293)..(293): a, c, t, g, unknown or other
  modified_base (300)..(300): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtcctgcatctcttggagacagatccaccgtcacgttcggccgggnagtcacgacattaactacttattagcctgtatcagcagagtcgaggatacgtacctaaattntgatctngtctcgcctaccgtcttcgaccgtaacggtccggggtcctacgtcgtaccggtcgtaggtcgggtcggtagactacgtaggactagtaactcactctacacactacaaccgactcgacctaccgtagagtagttaggttaaggggttaaacgtttagttaacctaggtaacctaacgtaaccgttagttaacggttcgggtaccggtacccgtcttcggttaacggttttaccggggacgggaacggttaaccggtaaggcgttaacgacggaactaaccggaaaaccgtaagttcgcgggttaccttcgaaccgtaacccg

SEQ ID NO: 389791 - DNA, 699 bp, Homo sapiens
  misc_feature: GZ8MTXP01BGTAJ.13.59.F04.1.454.CMB.2.raw
  modified_base (239)..(239): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccactccctccctgtcctgccattctcgttggagacagacgtccaccgtcacgttcggccgggnacgtaccacgtactaacttaactacttattacgccgttagtatcagacagaacgcgaggagtacgtaaccttaaattattagtactctctcgtctcgccgtccgtcgttgaccgtaccggtccggggtacctacgttccgtcggttacgtagggtcgggtcgggtggtactacgtaggacgtagtaacttcacttctaccacctacgtacccaaccctaccgtctaccctaccgtagaagttacgtttaggttaggggttaaacttttacgtacgttacgtacgtaacgtacgttacggttacgggtcgggtcccggtaccgttccgttcggttaaccgggtttcggggaccggggtaacgggttaacccgtaaggggtacgttaccggttaacggttaaaccgtaaaccggtaaacggtaacggttcggtacggttaccgtaacggaacccgttaaccg

SEQ ID NO: 389792 - DNA, 676 bp, Homo sapiens
  misc_feature: GZ8MTXP01BEJA4.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctccgaggtgccagatgcgacatccagatgagccagtcctccatcccaccctgtctgccgtctcgtcggagacgagggtccacctatcacgttggtacgggacaaggtcaagaactagttggactaacttacttaaatggtatcgagacaagtaagtcgacgggaccaacgcccccgaactcgtagactcgtacgactactcctacgttgacacgtagtcggactaccagtacgtaggttacgaggtcgacgtaagtagtactacgtagggaacttaacgttacttttacccacaacgtacgtacggtacgggtacctacgacgtccgtaagtaagttacgtttacgaccttaacgttacttagttacgtaacgtaaacgtacgttaccgtttaccccgttaccccggtaccccggtacgttaccggaaccggtaaacgggtaaccggtaaacggttaacggaaaccgttaacgaaacgggacgttaaccggttgggttaccgtcgtaacgccttaaccacgttcctaaccgttcgtaaccc

SEQ ID NO: 389793 - DNA, 566 bp, Homo sapiens
  misc_feature: GZ8MTXP01AGD1T.13.59.F04.1.454.CMB.2.raw
  modified_base (230)..(230): a, c, t, g, unknown or other
  modified_base (287)..(287): a, c, t, g, unknown or other
  modified_base (315)..(315): a, c, t, g, unknown or other
  modified_base (319)..(319): a, c, t, g, unknown or other
  modified_base (398)..(398): a, c, t, g, unknown or other
  modified_base (401)..(401): a, c, t, g, unknown or other
  modified_base (407)..(407): a, c, t, g, unknown or other
  modified_base (418)..(418): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctccctgtctgcatctctggagacagagtccaccgtcacgttggcccggngacgtcacgactattaacacttattagccttggtatacagcaagaggccaagggtanacgttaccctaaagtacttgtaatcttntcgntcgccgtccgtaccgttgccgtaacggtccggggtcctagtcgtcgttcgagtggacgtggattcagggacagtattcntcncaccancaaccgacctnactactcagtagtagtaggttagtaacttatacgtacgtgtaacgtacgttagtcggtcggtccgtaccgtcgttcgttcggttccgggacggacgggtaacgaggttacgacgaagtaacgaacgaacgtacgtgttcgtcgcgtcg

SEQ ID NO: 389794 - DNA, 490 bp, Homo sapiens
  misc_feature: GZ8MTXP02HLMJO.13.59.F04.1.454.CMB.2.raw
  modified_base (381)..(381): a, c, t, g, unknown or other
  modified_base (387)..(387): a, c, t, g, unknown or other
  modified_base (435)..(435): a, c, t, g, unknown or other
  modified_base (445)..(445): a, c, t, g, unknown or other
  modified_base (467)..(467): a, c, t, g, unknown or other
  modified_base (482)..(482): a, c, t, g, unknown or other
  modified_base (485)..(485): a, c, t, g, unknown or other
tcagtcacgtactacacgaccggtgctcgatttagtacacacacttagggattgggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcgttcagtgcggtggatctaggacagaattcactctcaccatcaccaacctncacccngaagatgtttggaagtttattactgtacagacctatagtggtgcccgntcatttcggngacgggaccaagggcgcgaganaacgaacgactacgngcncacac

SEQ ID NO: 389795 - DNA, 500 bp, Homo sapiens
  misc_feature: GZ8MTXP02GNRXT.13.59.F04.1.454.CMB.2.raw
  modified_base (356)..(356): a, c, t, g, unknown or other
  modified_base (433)..(433): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacactatttagcctggtatcagcagaagccagggagagtccctaaaattattgatctctgctgcgtccgcttgcaatcggggtcccatctcggttcagtggcggtggatctaggacngaaattcactctcaccatcaccaacctgcaccctgaagatgtggaagttatactgtcagacctatagtggtgcccgntcattttcggcggtagggaccaaagggtgacgagataacgaaaacgaactacgtggcctggcaaccg

SEQ ID NO: 389796 - DNA, 489 bp, Homo sapiens
  misc_feature: GZ8MTXP02GGFL1.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaatcggggtccatctcggttcagtggcggtggatctaggacagaattcactctcacatcaccaacctgcaccctgaagatgttggaagttattactgtcagacctatagtggtggcccgctcatttcggcggtacgggaccaaggtgcagatcgaaacgaactgtggctgcaacc

SEQ ID NO: 389797 - DNA, 487 bp, Homo sapiens
  misc_feature: GZ8MTXP02F8Z5K.13.59.F04.1.454.CMB.2.raw
  modified_base (431)..(431): a, c, t, g, unknown or other
  modified_base (441)..(441): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgccttgcaatcggggtcccatctcgttcagtggcggtggatctaggacagaattcactctcacatcaccaacctgcaccctgaagatgttggaagttattactgtcagacctatagtggtgccgntcatttcggnggtacgggaccaaggtcgcagatcgaaacgaactgtggctgacacc

SEQ ID NO: 389798 - DNA, 488 bp, Homo sapiens
  misc_feature: GZ8MTXP02HAYMJ.13.59.F04.1.454.CMB.2.raw
  modified_base (215)..(215): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcgagtcacgacattaacactattagcctggtatcagcagaagccaggagagtccctaaattattgatctctgctgcgtccgcctgcaactcggggtcccatctcggttcagtggcgtggatctaggacagaattcactctcacatcacaacctgcaccctgaacgatgttgaagtttataactgtacagacctatagtgtgccgctcattttcggcggacggaccgaaaggtcgacagataacgaaacgaactgagctgacac

SEQ ID NO: 389799 - DNA, 514 bp, Homo sapiens
  misc_feature: GZ8MTXP02HVB98.13.59.F04.1.454.CMB.2.raw
  modified_base (434)..(434): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgccttgcaactcggggtcccatctcggttcagtggcgtggatctaggacagaatcactctcacatcacaacctgcaccctgaacgatgttggaagtttattactgtcagacctatagtggtggcccgntctacgttttcggcggtacgggaccaaaggtcgaccgtaagactaacgaaacgaaaccgtgtaggctacggactaacccg

SEQ ID NO: 389800 - DNA, 479 bp, Homo sapiens
  misc_feature: GZ8MTXP02G4JOT.13.59.F04.1.454.CMB.2.raw
  modified_base (377)..(377): a, c, t, g, unknown or other
  modified_base (435)..(435): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacataacactattagcctggtatcagcagaagccaggagagtccctaaattattgatctctgctgcgtccgccttgcaactcggggtccatctcggttcagtgcgtggatctaggacagaattcactctcaccatcaccaacctncaccctgaagaatgtgaagttataactgtcagactatagtgtgccgctcatttccggngaggaccaaaggtgacagataacaaacgaactagagcgcgacac

SEQ ID NO: 389801 - DNA, 489 bp, Homo sapiens
  misc_feature: GZ8MTXP02JLRX1.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggcagtcacgacattaacacttattagcctggtatcagcagaagccagggagagtccctaaatattgatctctgctgcgtccgccttgcaactcggggtccatctcggttcagtggcgtggatctaggacagattcactctcacatcacaacctgcaccctgaacgatgttgaagttattactgtcagacctatagtgtgccgctctacgtttcggcggtacgggaccaagggtcgaccgagatcgaaacgactacgtgctgcaacc

SEQ ID NO: 389802 - DNA, 480 bp, Homo sapiens
  misc_feature: GZ8MTXP02IYXPJ.13.59.F04.1.454.CMB.2.raw
  modified_base (215)..(215): a, c, t, g, unknown or other
  modified_base (273)..(273): a, c, t, g, unknown or other
  modified_base (291)..(291): a, c, t, g, unknown or other
  modified_base (386)..(386): a, c, t, g, unknown or other
  modified_base (424)..(424): a, c, t, g, unknown or other
  modified_base (455)..(455): a, c, t, g, unknown or other
  modified_base (475)..(475): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgcgggcagtcacgacattaacactattagcctggtatcagcagaagccaggganagtccctaaatattgatntctgctgcgtcgcttgcaatcggggtccatctcggttcagtggcgtggatctaggacagaaattcactctcacatcacaacctgcaccctagaanatgttagaagtttatactgtcagactatagtgtgccgntctatttcggcgaggaccaaagtcgacaganaacgaacgaacgtacgtgcncacac

SEQ ID NO: 389803 - DNA, 479 bp, Homo sapiens
  misc_feature: GZ8MTXP02F0U5Z.13.59.F04.1.454.CMB.2.raw
  modified_base (383)..(383): a, c, t, g, unknown or other
  modified_base (429)..(429): a, c, t, g, unknown or other
  modified_base (452)..(452): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggcagtcacgacattaacactattagcctggtatcagcagaagccagggagagtccctaaattattgatctctgctgcgtccgcttgcaatcggggtccatctcgttcagtggcgtgatctaggacagaattcactctcacatcacaacctgcaccctgaanatgtgaagttatactgtacagactatagtgtgccgctcatttcggngacgggaccaaaggtcgacaganaacgaacgaacgtacgtggcgcgacac

SEQ ID NO: 389804 - DNA, 503 bp, Homo sapiens
  misc_feature: GZ8MTXP02GT438.13.59.F04.1.454.CMB.2.raw
  modified_base (436)..(436): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacactattagcctggtatcagcagaagccagggagagtccctaaattattgatctctgctgcgtccgcctgcaacgtcggggtccatctcggttcagtggcggtggatcgtaggacagaattcactctcacatcaccacctgcaccctgaacgatgttagaagttattactgtacagacctatagtggtggcccgntcgtagtttcgggcggtacgggtaccaggtcgacgagagtaacgaaacgactgtagctgactaaccg

SEQ ID NO: 389805 - DNA, 476 bp, Homo sapiens
  misc_feature: GZ8MTXP02FXDAM.13.59.F04.1.454.CMB.2.raw
  modified_base (224)..(224): a, c, t, g, unknown or other
  modified_base (273)..(273): a, c, t, g, unknown or other
  modified_base (377)..(377): a, c, t, g, unknown or other
  modified_base (385)..(385): a, c, t, g, unknown or other
  modified_base (396)..(396): a, c, t, g, unknown or other
  modified_base (420)..(420): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcacgtcacttgccggnagtcacgacattaacacttattagcctggtatcagcagaagccaggganagtccctaaattattgatctctgctgcgtccgcttgcaactcggggtcccatctcggtcagtggcgtggatctaggacagaattcactctcacatcacaacctncacctganatgtgaagttntactgtcagactatagtgtgccgntcatttcggcgtacggaccaaggtgacgagataacaacgaactacgtgcgcgcacc

SEQ ID NO: 389806 - DNA, 487 bp, Homo sapiens
  misc_feature: GZ8MTXP02G1NY4.13.59.F04.1.454.CMB.2.raw
  modified_base (225)..(225): a, c, t, g, unknown or other
  modified_base (438)..(438): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacactattagcctggtatcagcagaagccagggagagtccctaaattattgatctctgctgcgtccgccttgcaactcggggtcccatctcggttcagtggcgtggatctagacagattcactctcacatcaccaacctgcaccctgaagatgttagaagttattactgtcagacctatagtgtgccgctctatttcggnggtacggaccgaaaggtcgcagataacgaaacgactgtaggctcgcacc

SEQ ID NO: 389807 - DNA, 495 bp, Homo sapiens
  misc_feature: GZ8MTXP02JGCUJ.13.59.F04.1.454.CMB.2.raw
  modified_base (225)..(225): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtcacttgccgggnagtcacgacattaacacttattagcctggtatcagcagaagccagggagagtccctaaattatgatctctgctgcgtccgccttgcaatcggggtccatctcggttcagtggcggtgatctagacagattcactctcaccatcaccaacctgcaccctgacatgttaggaagtttatactgtcagacctatagtggtgccgctctacgttttcggcggtacgggaccgaaggtgaccgaggatcgaaacgtaactggtggctcggacacc

SEQ ID NO: 389808 - DNA, 530 bp, Homo sapiens
  misc_feature: GZ8MTXP02G8S82.13.59.F04.1.454.CMB.2.raw
  modified_base (295)..(295): a, c, t, g, unknown or other
  modified_base (390)..(390): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctntgctgcgtccgccttgcaactcggggtcccatctcggttcagtggcgtggatctagacagaattcatctcacatcaccaacctgacaccctgaanatgttggaagttattactgtacaagtacctagtagtggtggccgtctcctagttttccgggcgggtaacgggtacccgaaacgggttggaccaaggactaacgaaaacgtaaaccttggtagtccgtaggcctaaacccg

SEQ ID NO: 389809 - DNA, 492 bp, Homo sapiens
  misc_feature: GZ8MTXP02F9Z3E.13.59.F04.1.454.CMB.2.raw
  modified_base (431)..(431): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacactattagcctggtatcagcagaagccagggagagtccctaaattattgatctctgctgcgtccgccttgcaactcggggtccatctcgtcagtggcgtgatctaggacagattcactctcacatcaccaacctgcaccctagaacgatgttaggaagttattactgtacagtacctatagtggtgccgntcagtttcggcgacgggaccaaaggtgacgagataacgaaacgaactcgtaggctgcaacc

SEQ ID NO: 389810 - DNA, 525 bp, Homo sapiens
  misc_feature: GZ8MTXP02IOM3I.13.59.F04.1.454.CMB.2.raw
  modified_base (224)..(224): a, c, t, g, unknown or other
  modified_base (342)..(342): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggnagtcacgacattaacactattagcctggtatcagcagaagccaggagagtaccctaaatattgatctctgctgcgtccgcttgcaagtcggggtccatctcgtcagtggcggtgagtntagacagaaattcactctcaccatccaccaacctgaccaccctgaacgatgttaggtaaacgtttattaactggtacaagtacctagttaagtcggttcggcccgtctctacgttttcgggacggtagggacccgaaaggtcgacgtaggataacgaaacgaacttggacggtcaggcaaccg

SEQ ID NO: 389811 - DNA, 524 bp, Homo sapiens
  misc_feature: GZ8MTXP02I3KD2.13.59.F04.1.454.CMB.2.raw
  modified_base (200)..(200): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagaagccagggagagtccctaaattatgatctctgctgcgtccgccttgcaactcggggtccatctcggtcagtggcggtggatcgtagacagaatcactctcaccatcaccaacctgaccaccctagaacgatgttaggaaagtttattaactgttacaagtacctatagtggtcggcccgtctcgtacgttttcggcgggtacggacccgaaggtcgaccgtaagagtaacgaaacgaaacgtggagtctacggctaaccg

SEQ ID NO: 389812 - DNA, 493 bp, Homo sapiens
  misc_feature: GZ8MTXP02GZTYX.13.59.F04.1.454.CMB.2.raw
  modified_base (395)..(395): a, c, t, g, unknown or other
  modified_base (417)..(417): a, c, t, g, unknown or other
  modified_base (447)..(447): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattattgatctctgctgcgtccgccttgcaacgtcggggtcccatctcggttcagtggcggtggatctaggacagaatcactctcaccatcaccacctgccacctcgaanatgttaggaagttatactgtanagacctatagtggtgccgctctatttcggnggacggtaccaggtcgcagatcgaaaacgactgtagctcgctaacc

SEQ ID NO: 389813 - DNA, 492 bp, Homo sapiens
  misc_feature: GZ8MTXP02IGQ4N.13.59.F04.1.454.CMB.2.raw
  modified_base (201)..(201): a, c, t, g, unknown or other
  modified_base (275)..(275): a, c, t, g, unknown or other
  modified_base (365)..(365): a, c, t, g, unknown or other
  modified_base (386)..(386): a, c, t, g, unknown or other
  modified_base (444)..(444): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagaagccaggganagtccctaaattatgatctctgctgcgtccgccttgcaacgtccggggtccatctcggttcagtgggcgtgatcgtaggacagaatcacnctcacatcacacctgcacccngaacatgttaggaagtttatactgtcagacctaatagtggtgccgctctcgtttcggnggacggaccgaaggtcgcagacaacaaacgactgaggctacgctaacc

SEQ ID NO: 389814 - DNA, 510 bp, Homo sapiens
  misc_feature: GZ8MTXP02J3CWI.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctggagacagagtcaccgtcacttgccgggcagtcacgacattaacacttattagcctggtatcagcagaagccagggagagtaccctaaattatgatctctgctgcgtccgccttgcaacgtccggggtccagtctcggtcagtggcggtggatcgtagacagaatcactctcaccatccaccaacctcgaccaccccttagaagattgtaggaagttattactgtacagaccttagtaggtggtcggccgctctacgtttcgggcggacgggaccaaggtcgacgagaataacgaaacgactggaggcagcaac

SEQ ID NO: 389815 - DNA, 475 bp, Homo sapiens
  misc_feature: GZ8MTXP02GPBUX.13.59.F04.1.454.CMB.2.raw
  modified_base (382)..(382): a, c, t, g, unknown or other
  modified_base (465)..(465): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccaggagagtccctaaatattgatctctgctgcgtcgccttgcaatcggggtccatctcgttcagtggcgtggatctaggacagatcatctcacatcacaacctgcaccctgaanatgttgagttatactgtcagactatagtgtgccgctctatttcggcggtacgggaccaaggtgacgagatcgaaacgaactgnggctgacacc

SEQ ID NO: 389816 - DNA, 514 bp, Homo sapiens
  misc_feature: GZ8MTXP02HODXO.13.59.F04.1.454.CMB.2.raw
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccaggagagtccctaaatatgatctctgctgcgtccgccttgcaactcggggtccatctcggttcagtggcgtgatcgtaggacagaattcactctcacatcaccaacctgcaccctgaagatgttagaagtttatactgtcagacctagtagtggtcgcccgctcctagttttccggacgggacggaccgtaaacggggtcgacgaagaactaacgaaacgaacgtacgtacgtacgtacgacgacg

SEQ ID NO: 389817 - DNA, 499 bp, Homo sapiens
  misc_feature: GZ8MTXP02G1RMR.13.59.F04.1.454.CMB.2.raw
  modified_base (383)..(383): a, c, t, g, unknown or other
  modified_base (416)..(416): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagagccagggagagtccctaaattatgatctctgctgcgtccgccttgcaacgtcggggtccatctcggttcagtggcggtggatctaggacagaaattcactctcaccatcaccaacctncaccctgaagatgttaggaagttatactgttanagacctatagtggtgccgctcacttttcggcggagggaccaaagggtgacgagataacaacgaactacgtaggcgtacgacac

SEQ ID NO: 389818 - DNA, 522 bp, Homo sapiens
  misc_feature: GZ8MTXP02GBCNM.13.59.F04.1.454.CMB.2.raw
  modified_base (226)..(226): a, c, t, g, unknown or other
  modified_base (355)..(355): a, c, t, g, unknown or other
  modified_base (436)..(436): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctctgctgcgtccgcttgcaacgtcggggtccatctcggttcagtggcgtggatcgtaganagattcactctcacatcaccacctgccaccctgacatgttagtaagtttattactgtacagtactagtagtggtgcccgtntcgtacgtttcgggacgggtacgggaccgaagggtcgacgaggtaataacgaaaacggtacgtacggtggacttaggacctaaccg

SEQ ID NO: 389819 - DNA, 494 bp, Homo sapiens
  misc_feature: GZ8MTXP02HI5J4.13.59.F04.1.454.CMB.2.raw
  modified_base (435)..(435): a, c, t, g, unknown or other
  modified_base (447)..(447): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacactattagcctggtatcagcagaagccagggagagtccctaaattattgatctctgctgcgtccgccttgcaagtcggggtccatctcggttcagtggcggtggatctaggacagaattcactctcaccatcaccaacctgcaccctgaagagtgttaggaagtttattactgttcagactatagtgtgccgtntctagtttcggnggtacggaccgaaggtcgcagataacgaaagactagtggctcgcaac

SEQ ID NO: 389820 - DNA, 497 bp, Homo sapiens
  misc_feature: GZ8MTXP02FXE0T.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattattgatctctgctgcgtccgccttgcaatcggggtcccatctcggttcacgtggcggtggatctaggacagattcactctcacatcacaacctgcaccctgaagatagttggaagttattactgtcagacctatagtgtggcccgctctatttcggcggtagggaccaaagggtgacgagactcgaaaacgaactgtcggctagcaacc

SEQ ID NO: 389821 - DNA, 532 bp, Homo sapiens
  misc_feature: GZ8MTXP02IS1ZL.13.59.F04.1.454.CMB.2.raw
  modified_base (201)..(201): a, c, t, g, unknown or other
  modified_base (458)..(458): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcgagtcacgacattaacacttattagcctggtatcagcagaagccagggagagtcctaaattatgatctctgctgcgtccgtccttgctaacgtccgggggtcccagtcgttcggttccgagtgggcggtggatcgtaggacagtaattcactctcaccatcaccaacctcgaccaccctgaacgatgttaggaagtttattactgtacagacctagtagtggtcggcccgtntcgtagtttccggacgggtacgggaaccaaagggtcgacgaaggataacgaaacgaacgtgtagctcgacaacc

SEQ ID NO: 389822 - DNA, 507 bp, Homo sapiens
  misc_feature: GZ8MTXP02G8WMR.13.59.F04.1.454.CMB.2.raw
  modified_base (438)..(438): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgccttgcaacgtcggggtcccatctcggttcagtggcggtggatcgtagacagaattcactctcaccatcaccaacctgcaccctgaagatgttaggaagttattactgtacagacctatagtggtgcccgntctagtttcggcggaggtaccaagggtcgacaggactaacgaaaacgtaacgtgtggactcggacaacc

SEQ ID NO: 389823 - DNA, 496 bp, Homo sapiens
  misc_feature: GZ8MTXP02FUEM4.13.59.F04.1.454.CMB.2.raw
  modified_base (226)..(226): a, c, t, g, unknown or other
  modified_base (411)..(411): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctctgctgcgtccgccttgcaatcggggtccatctcggttcagtggcgtggatctaggacagaattcatctcacatcaccaacctgcaccctagaacatgtggaagttattactgtnagactatagtggtgcccgctctatttcggcggtacgggaccaaaggtcgaccaggaatcgaaaacgaactgtcggtctcgcaacc

SEQ ID NO: 389824 - DNA, 498 bp, Homo sapiens
  misc_feature: GZ8MTXP02JQ9S3.13.59.F04.1.454.CMB.2.raw
  modified_base (215)..(215): a, c, t, g, unknown or other
  modified_base (471)..(471): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccggcagtcacgacattaacacttattagcctggtatcagcagaagccagggagagtccctaaattatgatctctgctgcgtccgccttgcaagtccggggtccatctcggttcagtggcggtggatctaggacagaatcactctcacatcaccacctcgcaccctgaacgatgttaggaagttattactgtacagacctagtagtggtgtcccgctctacgtttcggcggtacggaccgaggtgccaganaacgaaacgactcgtagctcgactacc

SEQ ID NO: 389825 - DNA, 494 bp, Homo sapiens
  misc_feature: GZ8MTXP02HQIRO.13.59.F04.1.454.CMB.2.raw
  modified_base (373)..(373): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacataacactattagcctggtatcagcagaagccaggagagtccctaaatattgatctctgctgcgtcgccttgcaactcggggtccatctcgttcagtggcgtgatctagacagaattcactctcacatcaccaacctnacaccctgaagatgttagaagtttattaactgtacagacctatagtggtgccgctctacgttttcggacggaggaccgaaaggtgaccagaataacgaacgaacgtacgtgcgtacgacac

SEQ ID NO: 389826 - DNA, 504 bp, Homo sapiens
  misc_feature: GZ8MTXP02GXPRX.13.59.F04.1.454.CMB.2.raw
  modified_base (201)..(201): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagaagccaggagagtccctaaattattgatctctgctgcgtccgccttgcaactcggggtccagtctcggttcagtggcggtggatcgtaggacagaattcactctcacatcaccaacctgcaccctgaacgatgttagaagtttatactgtacagacctatagtggtggcccgctctacgtttcggcggtacgggaccgaaaggtcgacgagataacgaaacgactgtagctcgacaaccg

SEQ ID NO: 389827 - DNA, 537 bp, Homo sapiens
  misc_feature: GZ8MTXP02JX702.13.59.F04.1.454.CMB.2.raw
  modified_base (394)..(394): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtggccgggtggatctagggacaggaattccactctcaccatcacacctgcacccngaagatgttagaagttattactgttcagtacctaatagtggtacggcccgcgttcgtacgttttccgggcgggtacggggaacccgaaaggttcgacagggtaactaacgaaacggaacctggtacggacttcggctaacccg

SEQ ID NO: 389828 - DNA, 566 bp, Homo sapiens
  misc_feature: GZ8MTXP02IUC04.13.59.F04.1.454.CMB.2.raw
  modified_base (205)..(205): a, c, t, g, unknown or other
  modified_base (220)..(220): a, c, t, g, unknown or other
  modified_base (232)..(232): a, c, t, g, unknown or other
  modified_base (257)..(257): a, c, t, g, unknown or other
  modified_base (420)..(420): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcattctcgttgganacagacgtcaccgtnacgttggccggngagtcacgacattaacacttattancctggtatcagcagaagccgagggagacgtacctaaattatgatctctgctgccgtccgtccttgccgaacgtccgggggtaccctagtccgttcggttccgaggtcgggcgggttggagttacgtaggaacaagtaatcactctacaccataccacaacctnaccacctagaatagtgttagtaagtttatacgtgtacaagtacctaagtcgtcggtcgccgtctacgttacggttcggacgggacggaccgaaggtgaccgaaggtactaacgaaacgtaacgttcgggtacgcgtacgtactacg

SEQ ID NO: 389829 - DNA, 528 bp, Homo sapiens
  misc_feature: GZ8MTXP02GXHIB.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagaagccagggagagtaccctaaattattgatctctgctgccgtccgccttgctaacgtccggggtccagtcgtcggttcaggtggcggtggatcgtagacagaattcactctcaccatccaccaacctgacaccctagaagtacgtgttaggaagtttattactgtacagtactagtagtggtcgccgtctctagtttcgggcggtacggaccgaaggtcgacgagaacaacgaaaacgtacgtacgtcggactcggactaaccg

SEQ ID NO: 389830 - DNA, 479 bp, Homo sapiens
  misc_feature: GZ8MTXP02F890Z.13.59.F04.1.454.CMB.2.raw
  modified_base (213)..(213): a, c, t, g, unknown or other
  modified_base (271)..(271): a, c, t, g, unknown or other
  modified_base (374)..(374): a, c, t, g, unknown or other
  modified_base (455)..(455): a, c, t, g, unknown or other
  modified_base (478)..(478): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtnacttgccggcagtcagacattaacacttattagcctggtatcagcagaagccaggganagtccctaaattatgatctctgctgcgtccgcttgcaatcggggtccatctcggttcagtggcgtggatcgtagacagaattcatctcaccatcaccaacctncacctacgagatagttgtagttattatagtctagacctatagtgtgccgctcacttcgtcggacggacgacgtgacagaanaacgaacgacgtacgtgcgcgcnc

SEQ ID NO: 389831 - DNA, 494 bp, Homo sapiens
  misc_feature: GZ8MTXP02HLHQG.13.59.F04.1.454.CMB.2.raw
  modified_base (200)..(200): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcgagtcacgacattaacactattagcctggtatcagcagaagccaggagagtccctaaatatgatctctgctgcgtccgccttgcaatcggggtcccatctcggttcagtggcggtgatctagacagaattcactctcaccatcaccaacctgcaccctgaagatgttagaagtttatactgtacagacctatagtggtgccgctctacgtttcggcggacggaccgaaaggtcgacagataacgaaaacgaactgtggctcggacaccg

SEQ ID NO: 389832 - DNA, 509 bp, Homo sapiens
  misc_feature: GZ8MTXP02HDUOO.13.59.F04.1.454.CMB.2.raw
  modified_base (200)..(200): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcgagtcacgacataacactattagcctggtatcagcagaagccagggagagtccctaaatattgatctctgctgcgtccgccttgcaatcggggtccatctcggttcagtggcggtggatctagacagaattcactctcaccatcacaacctgcaccctgaacgatgttggaagtttatactgtacagacctatagtggtgcccgctctacttttcggcggtacggaccgaaaggtcgacgaggactaacgaaaacgtaaacgtggtaggtctacggacaacccg

SEQ ID NO: 389833 - DNA, 489 bp, Homo sapiens
  misc_feature: GZ8MTXP02G6M3F.13.59.F04.1.454.CMB.2.raw
  modified_base (225)..(225): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtccctaaattattgatctctgctgcgtccgccttgcaatcggggtccatctcggttcagtggcggtggatctaggacagaattcactctcacatcaccaacctgcaccctgaagatgttagagttattactgtacagacctatagtggtgccgctcatttcggcggtacgggaccaaaggtcgcagataacgaaacgaactgtggctgcaacc

SEQ ID NO: 389834 - DNA, 546 bp, Homo sapiens
  misc_feature: GZ8MTXP02I3LZQ.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtccatctcgttcagtggcggtggatctaggacagatcactctcacatcaccaacctgcaccctgaacgatgttaggaagtttattactgtacacgaaccttagtagtggtcggcccgcgttctacgttttcgggacggtacggggtaacccgaaagggttcgacgaacgtaacttaacgaaaaaccggtaactacgggtacggtccttacggacctaaacccg

SEQ ID NO: 389835 - DNA, 545 bp, Homo sapiens
  misc_feature: GZ8MTXP02G4BJD.13.59.F04.1.454.CMB.2.raw
  modified_base (201)..(201): a, c, t, g, unknown or other
  modified_base (227)..(227): a, c, t, g, unknown or other
  modified_base (276)..(276): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggngagtcacgacattaacacttattagcctggtatcagcagagccaggganagtaccctaaattatgatctctgctgcgtccgctgctaacgtcggggtcctagtctcggtcagtgggcgtggatcgtagacagtacttcactctacaccataccaccaacctcgacctaccctagaacgtattggttaggtaagtttactacgtgtacagtaccgtagtagtcggtcggccgtctcgtacgtttcgggacgggtaacgggtaccgaggttcgaccgtagacgtaacgaaacgtacgtacggtgtacctcggactaaccg

SEQ ID NO: 389836 - DNA, 489 bp, Homo sapiens
  misc_feature: GZ8MTXP02GOC40.13.59.F04.1.454.CMB.2.raw
  modified_base (438)..(438): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaactcggggtcccatctcggttcagtggcggtggatctaggacaggaaattcactctcaccatcaccaacctgcaccctgaacgatgttggaagtttattactgtcagacctatagtgtgccgntctatttcggcggaggaccaaggtcgcagatcgaaacgactgaggctgcac

SEQ ID NO: 389837 - DNA, 522 bp, Homo sapiens
  misc_feature: GZ8MTXP02JX4DB.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtaggcccgtctctacgttttcggcgggtacgggggtaacccaagggttcgacgaagataacgaaaacgaactacggtggactcggactaacccg

SEQ ID NO: 389838 - DNA, 496 bp, Homo sapiens
  misc_feature: GZ8MTXP02JZP3Y.13.59.F04.1.454.CMB.2.raw
  modified_base (440)..(440): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattattgatctctgctgcgtccgccttgcaactcgggggtcccatctcggttcagtggcggtggatcgtaggacagaattcactctcaccatcaccaacctgcaccctgaacgatgttggaagttattactgtcagacctatagtggtggcccgntctacgttttcggcggacgggaccaggtcgcagatcgaaacgaactgtagctgcac

SEQ ID NO: 389839 - DNA, 558 bp, Homo sapiens
  misc_feature: GZ8MTXP02GT1P4.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagaagccaggagagtccctaaattattgatctctgctgcgtccgcctgcaacgtcggggtccagtctcggttcagtgggtcggtggtagtcgtaggacagtaattcactctcaccactaccaccaaccctcgaccaaccctagaacgtattggttaggtaagtttagttacttagtacaagtacctagtaggtcggtcggtcccgtcgtcgtacgtttcggacgggtacgggaccgtaaagggtcgacgagaacgtaaccgtaaaacggaacgtggtacggtctacggactaaccg

SEQ ID NO: 389840 - DNA, 496 bp, Homo sapiens
  misc_feature: GZ8MTXP02GKVDA.13.59.F04.1.454.CMB.2.raw
  modified_base (226)..(226): a, c, t, g, unknown or other
  modified_base (384)..(384): a, c, t, g, unknown or other
  modified_base (394)..(394): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctctgctgcgtccgccttgcaactcggggtccatctcggttcagtggcgtggatctaggacagaaattcactctcaccatcaccaacctncaccctgaanatgttggaagttattactgtcagacctatagtgtgccgctctattttcggcggacgggaccaaaggtcgacagataacaaacgaaactagtggctcgcaacc

SEQ ID NO: 389841 - DNA, 497 bp, Homo sapiens
  misc_feature: GZ8MTXP02I7WVM.13.59.F04.1.454.CMB.2.raw
  modified_base (226)..(226): a, c, t, g, unknown or other
  modified_base (444)..(444): a, c, t, g, unknown or other
  modified_base (486)..(486): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtccctaaattattgatctctgctgcgtccgccttgcaacgtcggggtccatctcggtcagtgggcggtggatctaggacagattcactctcacatcacacctgcacctgacatgttagaagtttatactgttacagacctatagtggtcgccgctctattttcgggnggtacgggaccgaaaggtcgacgagatcgaaaacgaacttgngactgctaacc

SEQ ID NO: 389842 - DNA, 501 bp, Homo sapiens
  misc_feature: GZ8MTXP02JX84A.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgccttgcaatcggggtccatctcggttcagtggcggtggatctaggacagattcactctcacatcaccaacctgccaccctgaacgatgttaggaagttattactgtcagacctatagtggtgcccgctctagttttcggcggtacgggaccgaggtcgcgagataacgaaacgaacgtgtcggctacggcaacc

SEQ ID NO: 389843 - DNA, 518 bp, Homo sapiens
  misc_feature: GZ8MTXP02JK4IL.13.59.F04.1.454.CMB.2.raw
  modified_base (274)..(274): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccaggganagtccctaaattattgatctctgctgcgtccgccttgcaactcggggtccatctcggttcagtggcggtggatcgtaggacagaatcactctcacatcacaacctgcacctcgaagactagttgaagttattactgtcagacctagtagtggtggtccgctctacgtttcggacgggtacgggaccgtaaagggtcgaccgagaactaacgaaaacgaactacggtaggccgtcggacaacccg

SEQ ID NO: 389844 - DNA, 515 bp, Homo sapiens
  misc_feature: GZ8MTXP02F3Y4M.13.59.F04.1.454.CMB.2.raw
  modified_base (201)..(201): a, c, t, g, unknown or other
  modified_base (227)..(227): a, c, t, g, unknown or other
  modified_base (389)..(389): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggnagtcacgacattaacacttattagcctggtatcagcagaagccagggagagtaccctaaattattgatctctgctgcgtccgcttgcaacgtcggggtccatctcggttcagtggcgtggatcgtagacagaattcactctcacatcaccactgcacctganatgtagagttatactgtacagactatagtgtggccgtctctacgtttcggacgggtacggaccgtaaaggtcgaccgaggtaactaacgaaaaacggtaacctaggtacggcgtcggactaacccg

SEQ ID NO: 389845 - DNA, 488 bp, Homo sapiens
  misc_feature: GZ8MTXP02GVQTX.13.59.F04.1.454.CMB.2.raw
  modified_base (225)..(225): a, c, t, g, unknown or other
  modified_base (274)..(274): a, c, t, g, unknown or other
  modified_base (378)..(378): a, c, t, g, unknown or other
  modified_base (407)..(407): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccaggganagtccctaaattattgatctctgctgcgtccgcttgcaactcggggtccatctcggttcagtggcgtggatctaggacagaattcactctcacatcacaacctncacctcagatgttgtagttattactagtnagacctatagtgttgccgctctactttcggtcggacggaccgaacgggacgacgagataacgaacgacgtagtgctcgcac

SEQ ID NO: 389846 - DNA, 510 bp, Homo sapiens
  misc_feature: GZ8MTXP02FTEZL.13.59.F04.1.454.CMB.2.raw
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacactattagcctggtatcagcagaagccagggagagtccctaaattattgatctctgctgcgtccgcttgcaatcggggtcccatctcgttcagtggcggtggatctagacagaattcactctcacatcaccaacctgaccaccctagaacgatgttaggtaagtttattactgtcagtacctatagtggtcgccgctctacgttttcggacggtaggggtaccaaggttcgacgagaataacgaaaacgactaggtcggctcggcaacc

SEQ ID NO: 389847 - DNA, 514 bp, Homo sapiens
  misc_feature: GZ8MTXP02GPOMF.13.59.F04.1.454.CMB.2.raw
  modified_base (346)..(346): a, c, t, g, unknown or other
  modified_base (446)..(446): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaactcgggggtcccagtctcggttcagtggnggtggatctagggacagaattcactctcaccatccaccaaccctgccaccctgaagactgttggtaagttattactagtcagacctatagtggtggccgntctagttttcgggacggtacgggaccgaaaggtcgactagataacgaaacgaactgtggctggcaacc

SEQ ID NO: 389848 - DNA, 478 bp, Homo sapiens
  misc_feature: GZ8MTXP02HD67P.13.59.F04.1.454.CMB.2.raw
  modified_base (195)..(195): a, c, t, g, unknown or other
  modified_base (215)..(215): a, c, t, g, unknown or other
  modified_base (229)..(229): a, c, t, g, unknown or other
  modified_base (234)..(234): a, c, t, g, unknown or other
  modified_base (253)..(254): a, c, t, g, unknown or other
  modified_base (256)..(257): a, c, t, g, unknown or other
  modified_base (259)..(259): a, c, t, g, unknown or other
  modified_base (261)..(261): a, c, t, g, unknown or other
  modified_base (278)..(278): a, c, t, g, unknown or other
  modified_base (281)..(281): a, c, t, g, unknown or other
  modified_base (283)..(283): a, c, t, g, unknown or other
  modified_base (285)..(286): a, c, t, g, unknown or other
  modified_base (293)..(293): a, c, t, g, unknown or other
  modified_base (296)..(297): a, c, t, g, unknown or other
  modified_base (307)..(307): a, c, t, g, unknown or other
  modified_base (315)..(315): a, c, t, g, unknown or other
  modified_base (319)..(319): a, c, t, g, unknown or other
  modified_base (321)..(321): a, c, t, g, unknown or other
  modified_base (326)..(326): a, c, t, g, unknown or other
  modified_base (330)..(330): a, c, t, g, unknown or other
  modified_base (387)..(387): a, c, t, g, unknown or other
  modified_base (389)..(389): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctnttggagacagagtcaccgtnacttgcggcgagtnacganataacattattagctgtannannananagagagatactaatatnatntntnntgcgtcnctnnacgtcggtcntctcgtgngtgngngatanaganatatacactctacacacacacaaccacacaccagagatagtagtaagttatatatananactagtagtgtcgccgctctacgttacggtacggacggacgaacgacgacgaagaacgaacgaaacgtaacgtacgtagacgacgacac

SEQ ID NO: 389849 - DNA, 485 bp, Homo sapiens
  misc_feature: GZ8MTXP02GVJFK.13.59.F04.1.454.CMB.2.raw
  modified_base (427)..(427): a, c, t, g, unknown or other
  modified_base (434)..(434): a, c, t, g, unknown or other
  modified_base (445)..(445): a, c, t, g, unknown or other
  modified_base (458)..(458): a, c, t, g, unknown or other
  modified_base (467)..(467): a, c, t, g, unknown or other
  modified_base (477)..(477): a, c, t, g, unknown or other
  modified_base (480)..(480): a, c, t, g, unknown or other
  modified_base (482)..(482): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcacgtcacttgccggcagtcacgacataacactattagctggtatcagcagaagccagggagagtccctaaattattgatctctgctgcgtccgccttgcaaactcgggggtcccatcgtcggtttcagtggcggtggatcgtaggacagaattcaactctcaccatcaccaacctgcaccctgaagatgttggaattattaactgtacagactatagngtgccgntcagtttcggnggacggacaaggngcagataanaacaactagngcncncac

SEQ ID NO: 389850 - DNA, 497 bp, Homo sapiens
  misc_feature: GZ8MTXP02F78ST.13.59.F04.1.454.CMB.2.raw
  modified_base (226)..(226): a, c, t, g, unknown or other
  modified_base (446)..(446): a, c, t, g, unknown or other
  modified_base (488)..(488): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctctgctgcgtccgccttgcaactcggggtcccatctcggttcagtggcggtggatctaggacagaattcactctcacatcaccacctgcaccctagaacatagtgtaagttattactgtcaagacctatagtgtgccgctcacgtttcggnggtacggaccgaaaggtgacgagataacgaaaacgactaggngctcgacac

SEQ ID NO: 389851 - DNA, 517 bp, Homo sapiens
  misc_feature: GZ8MTXP02I1LR8.13.59.F04.1.454.CMB.2.raw
  modified_base (226)..(226): a, c, t, g, unknown or other
  modified_base (339)..(339): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttattagcctggtatcagcagaagccagggagagtccctaaattatgatctctgctgcgtccgccttgcaactctcggggtccattctcggttcngtgggcggtgatcgtaggacagaattcactctcacatcaccaactcgccaccctgaacgatgttaggtagttattactgtacagacctataggtggtcgcccgcttactacgttttacggcgggtacgggaccgaggtacgacgagaagtacgaaacgtaactggtggtctacggacc

SEQ ID NO: 389852 - DNA, 500 bp, Homo sapiens
  misc_feature: GZ8MTXP02I1HAP.13.59.F04.1.454.CMB.2.raw
  modified_base (226)..(226): a, c, t, g, unknown or other
  modified_base (274)..(274): a, c, t, g, unknown or other
  modified_base (429)..(429): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagganagtccctaaattattgatctctgctgcgtccgccttgcaatcggggtccatctcgttcagtggcgtgatctagacagaattcactctcacatcacaacctgcaccctgaacgatgttagaagtttataactgtacagacctatagtggtgcccgntctagtttcggacggtacggaccaaggtgacgaggactaacgaaaacgactaggtacggactcgactaacc

SEQ ID NO: 389853 - DNA, 521 bp, Homo sapiens
  misc_feature: GZ8MTXP02HJI96.13.59.F04.1.454.CMB.2.raw
  modified_base (215)..(215): a, c, t, g, unknown or other
  modified_base (461)..(461): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagtcacgacattaacacttattagcctggtatcagcagaagccagggagagtccctaaattatgatctctgctgcgtccgccttgcaacgtccggggtccagtcttcggttcagtgggcggtggatcgtaggacagattcactctcaccatcaccaactcgccaccctgaacgtatgtttaggaagtttatacgtgtacagacctatacggtggtgcccgtctctagtttccggnggtacgggaccaaggtcgcgaggaactcgaaaacggaactggtacggcgtacgacaaccg

SEQ ID NO: 389854 - DNA, 511 bp, Homo sapiens
  misc_feature: GZ8MTXP02H7RK6.13.59.F04.1.454.CMB.2.raw
  modified_base (336)..(336): a, c, t, g, unknown or other
  modified_base (480)..(480): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctcctgtctgcatctcttggagacagagtcaccgtcacttgccgggcgagtcacgacattaacacttattagcctggtatcagcagaagccagggagagtaccctaaattatgatctctgctgcgtccgcctgcaacgtcggggtcccatctcggtnagtggcgtgatcgtagacagtaactcactctcacactcaacctaacctgccacccgtagaagtacttgttaggaagtttattactgtcagtacctatgtaggtcgccgcgtctagtttcggcggacggaccgaaggtcgacganagtaacgaaacgacgtggtacgctagctaac

SEQ ID NO: 389855 - DNA, 503 bp, Homo sapiens
  misc_feature: GZ8MTXP02JC09G.13.59.F04.1.454.CMB.2.raw
  modified_base (226)..(226): a, c, t, g, unknown or other
  modified_base (399)..(399): a, c, t, g, unknown or other
  modified_base (495)..(495): a, c, t, g, unknown or other
  modified_base (498)..(498): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtccctaaattattgatctctgctgcgtccgccttgcaacgtcgggggtcccatcctcggttcagtggcggtggatctaggacagaattcactctcacatccaccaaacctgcaccctagaanatgttaggtaagtttattaacctggttacagacctatagtggtggccgctcacttttcggcggagggaccaaggtgacagatcgaaacgaactggngcncacac

SEQ ID NO: 389856 - DNA, 534 bp, Homo sapiens
  misc_feature: GZ8MTXP02GS471.13.59.F04.1.454.CMB.2.raw
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctgtatcagcagagccaggagagtccctaaattattgatctctgctgcgtccgccttgcaacgtcggggtcccatcctcggttcagtggcgtggatcgtaggacagattcactctcacatcacccaacctgaccaccctagaacgtattgttaggtaaagtttattacctaggttacacgtaacctagttaagtcgggtcgtcccgtctcttacgttttcgggcgggaacggacccgaaaggtcgaccaggactaacgaaacgaactagtgcgtacgcaaccg

SEQ ID NO: 389857 - DNA, 501 bp, Homo sapiens
  misc_feature: GZ8MTXP02IH1P7.13.59.F04.1.454.CMB.2.raw
  modified_base (226)..(226): a, c, t, g, unknown or other
  modified_base (396)..(396): a, c, t, g, unknown or other
  modified_base (437)..(437): a, c, t, g, unknown or other
  modified_base (475)..(475): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttattagcctggtatcagcagaagccagggagagtccctaaattattgatctctgctgcgtccgccttgcaacgtcggggtcccatctcggttcagtgggcggtggagtctaggacagaattcactctcacatcaccacctgcaccctgaanatgttaggagtttatactgacagacctatagtgtggcccgntctagtttcggcggtacgggaccaaggtcgacgagtanaacgaaacgactgtggactgacaacc

SEQ ID NO: 389858 - DNA, 503 bp, Homo sapiens
  misc_feature: GZ8MTXP02IY5WQ.13.59.F04.1.454.CMB.2.raw
  modified_base (201)..(201): a, c, t, g, unknown or other
  modified_base (215)..(215): a, c, t, g, unknown or other
  modified_base (226)..(226): a, c, t, g, unknown or other
  modified_base (389)..(389): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggnagtcacgacattaacacttattagcctggtatcagcagaagccagggagagtaccctaaattattgatctctgctgcgtccgccttgcaatcggggtcccatctcggttcagtggcgtggatctaggacagaattcactctcacatcaccaacctgcaccctnacgatgttagaagttattactgtacacgacctatagtggtcggccgctctagtttcggcggtacgggaccgaaggtcgacgaggaatcgaaaacgaacgtgtgctcgacaaccg

SEQ ID NO: 389859 - DNA, 498 bp, Homo sapiens
  misc_feature: GZ8MTXP02FVSU0.13.59.F04.1.454.CMB.2.raw
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccaggagagtccctaaattattgatctctgctgcgtccgccttgcaatcggggtcccatctcggttcagtggcggtggatctaggacagaattcactactcacatcaccacctgacaccctagaacgatgtagaagttattactgtcagactatagtggtgccgctctacgtttcggcggtagggaccgaaaggtcggacagactaacgaaacgaactcgtagctcgcaacc

SEQ ID NO: 389860 - DNA, 489 bp, Homo sapiens
  misc_feature: GZ8MTXP02G5DBZ.13.59.F04.1.454.CMB.2.raw
  modified_base (225)..(225): a, c, t, g, unknown or other
  modified_base (430)..(430): a, c, t, g, unknown or other
  modified_base (440)..(440): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacactattagcctggtatcagcagaagccagggagagtccctaaatattgatctctgctgcgtccgccttgcaatcggggtccatctcggttcagtggcggtggatctaggacagaattcactctcacatcaccaacctgacaccctgaacgatgttagaagttattactgtcagacctatagtggtgccgntcatttcggnggtacgggaccaaaggtcgacagatcgaaacgaactgtagctcgcaacc

SEQ ID NO: 389861 - DNA, 538 bp, Homo sapiens
  misc_feature: GZ8MTXP02JMFJS.13.59.F04.1.454.CMB.2.raw
  modified_base (299)..(299): a, c, t, g, unknown or other
  modified_base (386)..(386): a, c, t, g, unknown or other
  modified_base (422)..(422): a, c, t, g, unknown or other
  modified_base (450)..(450): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctcctgtctgcatctcgttggagacagacgtccaccgtctacgttcggccgggcgagtcacgacattaacacttattacgcctggtatcagcagagccgagggagagtacctaaattntgatctctgctgcgtccgcttgcgacgtcggggtcctagtcgtcggtcaggtggcgggtgagtctaggacagtaactcactctcacntacacgactcgcacctgaacagtgtagtagttaatntgtacacgtactagtaggtggtcggccncgtcgttacgtttcgggcggacgggtaaccgagggtacgaccgagacgtaaccgaaacgtaacgtggtacggacgttcggactacccg

SEQ ID NO: 389862 - DNA, 508 bp, Homo sapiens
  misc_feature: GZ8MTXP02HOEJ0.13.59.F04.1.454.CMB.2.raw
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttattagcctggtatcagcagaagccagggagagtccctaaattattgatctctgctgcgtccgccttgcaacgtcggggtcccatctcggttcagtggcggtggatcgtaggacagaattcactctcaccatccacaacctgaccaccctgaacgatgttagaagtttatactgtacagacctatagtggtgcccgctctatttcgggcggacgggaccgaaaggtcgacagataacgaaacgaacgtgacggctcggacaacc

SEQ ID NO: 389863 - DNA, 528 bp, Homo sapiens
  misc_feature: GZ8MTXP02JOZZW.13.59.F04.1.454.CMB.2.raw
  modified_base (294)..(294): a, c, t, g, unknown or other
  modified_base (381)..(381): a, c, t, g, unknown or other
  modified_base (387)..(387): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaatatgatctntgctgcgtccgcttgcaacgtcggggtcccatctcggttcagtgggcggtggatctaggacagaattcactctcacatcacaccgtncacctnagatgttagaagttatactgtacagtactataggttcgtcggcccgtctcgtacgttttcgggaccggacgggaccgaaagggttgaccgaaggaacttaacgaaaacgtaaccgtacggtaggacttcggactaaacccg

SEQ ID NO: 389864 - DNA, 512 bp, Homo sapiens
  misc_feature: GZ8MTXP02GZH9W.13.59.F04.1.454.CMB.2.raw
  modified_base (226)..(226): a, c, t, g, unknown or other
  modified_base (437)..(437): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttatttagcctggtatcagcagaagccagggagagtccctaaattatgatctctgctgcgtccgccttgcaacgtcggggtccagtctcggttcagtggcgtggatctaggacagattcactctcacatcaccaacctgcaccctgaacgatgttagaagttattactgtacagtactatagtggtcgccgtntcgtacgtttcggcggtacggaccgaaggtcgacaggataacgaaaacgaaccgttgacggtctcggactaaccg

SEQ ID NO: 389865 - DNA, 541 bp, Homo sapiens
  misc_feature: GZ8MTXP02JNWAL.13.59.F04.1.454.CMB.2.raw
  modified_base (227)..(227): a, c, t, g, unknown or other
  modified_base (374)..(374): a, c, t, g, unknown or other
  modified_base (399)..(399): a, c, t, g, unknown or other
  modified_base (431)..(431): a, c, t, g, unknown or other
  modified_base (465)..(465): a, c, t, g, unknown or other
  modified_base (506)..(506): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggngagtcacgacattaacacttattagcctggtatcagcagaagccgagggagagtaccctaaattattgatctctgctgcgtccgcttgcaacgtcggggtccatctcggtcaggtggcgggtgatcgtaggacagtattcacttacnccaccactacccaacctaacccgtnaccacccttagaagtagtgttaggtaagtttnttacgtgtacagtacctagtagtggtcgcccgtntcgttaagtttcggacggacgggaccacgggtgacgagaanaaccgaaacgtaacgtggcggacgtcgactaaccg

SEQ ID NO: 389866 - DNA, 527 bp, Homo sapiens
  misc_feature: GZ8MTXP02H2779.13.59.F04.1.454.CMB.2.raw
  modified_base (374)..(374): a, c, t, g, unknown or other
  modified_base (435)..(435): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggtcgagtcacgacattaacacttattagcctggtatcagcagaagccagggagaggtccctaaagtattagatctctgctgcgtccgctgcaacgtcggggtccatctcgttcgagtggcggtgatcgtaggacagaatcactctcacanccacaactgacacctgaacgatgttagagtttatactgtcagacctagtagtggtggcccncgtctgttttacggggccgggaacggacccgaaaggggtcaccgtaagaactaacgaaacgaaccgttacgggtacggtcgtacgtacgacg

SEQ ID NO: 389867 - DNA, 499 bp, Homo sapiens
  misc_feature: GZ8MTXP02II79Q.13.59.F04.1.454.CMB.2.raw
  modified_base (201)..(201): a, c, t, g, unknown or other
  modified_base (226)..(226): a, c, t, g, unknown or other
  modified_base (437)..(437): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagaagccaggagagtccctaaattattgatactctgctgcgtccgccttgcaacgtcggggtcccatctacggttcagtgggcgtggagtctaggacagattcactctcacatcacacctgacaccctagaagactgttagaagtttattactgtacagactatagtgtagccgntctagtttcggcggacggaccgaagtcgacaagataacgaaacgaactgaggctagacaacc

SEQ ID NO: 389868 - DNA, 551 bp, Homo sapiens
  misc_feature: GZ8MTXP02HP52P.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgcccgggnagtcacgacattaacacttattagcctggtatcagcagaagccagggagagtaccctaaagttattgatctctgctgcgtccgccttgcaacgtccgggggtccccattccgttcggttccgagtgggtcgggtggatcgtaggacagtaattcaactctcacatccaccaacctgaccaccctagaagattggttagtaaagtttattacgtgtacgagtacctataggtggtcgcccgctctacgttttcgggcggacgggaccgaaaggtcgacgaagtacgtaacgtaaaacgaacgttagtacgtctacggactaaacc

SEQ ID NO: 389869 - DNA, 571 bp, Homo sapiens
  misc_feature: GZ8MTXP02IV73Y.13.59.F04.1.454.CMB.2.raw
  modified_base (201)..(201): a, c, t, g, unknown or other
  modified_base (354)..(354): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcagtcacgacattaacacttattagcctggtatcagcagaagccgagggagagtaccctaaattattgatctctgctgcgtccgtcctgctaacgtccggggtccatctcggttcagtgggcggtggntcgtagacagtatcactctcacatcaaccacctcgccaccctagaacgtagttaggttaggtaagtttattacttggtacaagtaccttaagtacggtggtcggcccgtctacgttacgtttcgggacgggtaacgggtaaccgtaagggtcgaacgtaacgtaacgtaaaccgtaaaacgtaaccgttaggtcggtaccttacggacctaaacccg

SEQ ID NO: 389870 - DNA, 541 bp, Homo sapiens
  misc_feature: GZ8MTXP02HTOJU.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgcccgggnagtcacgacattaacacttattagcctggtatcagcagaagccagggagagtccctaaattatgatctctgctgcgtccgccttgcaacgtcggggtcccatctcggttcagtggcgtgatctaggacagatcactctcacatcaccaacctgacaccctgaacgattgtaggtaagtttattactgtacagtacctatagtggtcgacccgtctctaacgttttcgggacggtacgggaccgtaaaggtcgaccgaaggtaataaccgaaaacgtaaaaccgttggtacgggtaccttacggacctaaacccg

SEQ ID NO: 389871 - DNA, 551 bp, Homo sapiens
  misc_feature: GZ8MTXP02JLCMM.13.59.F04.1.454.CMB.2.raw
  modified_base (200)..(200): a, c, t, g, unknown or other
  modified_base (214)..(214): a, c, t, g, unknown or other
  modified_base (274)..(274): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtnacttggccggcagtcacgacattaacacttattagcctggtatcagcagaagccaggganagtccctaaattattgatctctgctgcgtccgccttgcaacgtcggggtccatctcgtcagtggcggtgatcgtaggacagattcactctcaccatcaccaacctgaccaccctgaaagtataggttaggtaagtttattaactggttacagtacctaagtaaggtcggtcggcccgtctacgtaacgttttcgggacgggtaacgggaccgaaaggttcgaccgaggaacttaaccgaaaacgtaaaccgttacgggtacgtacgtacgacctacg

SEQ ID NO: 389872 - DNA, 510 bp, Homo sapiens
  misc_feature: GZ8MTXP02JEVPQ.13.59.F04.1.454.CMB.2.raw
  modified_base (201)..(201): a, c, t, g, unknown or other
  modified_base (274)..(274): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagagccaggganagtccctaaattattgatctctgctgcgtccgccttgcaacgtcggggtccatctcggttcagtggcggtgatctagacagaattcactctcaccatcaccaacctgccacctgaagatgttaggagttatactgtcagtacctatagtggtcgcccgtctctagttttccggcgggtacggaccgaaggtcgacgaggactaacgaaaacgtaacgtcgtaggctcgactaaccg

SEQ ID NO: 389873 - DNA, 549 bp, Homo sapiens
  misc_feature: GZ8MTXP02I41GE.13.59.F04.1.454.CMB.2.raw
  modified_base (201)..(201): a, c, t, g, unknown or other
  modified_base (215)..(215): a, c, t, g, unknown or other
  modified_base (226)..(226): a, c, t, g, unknown or other
  modified_base (274)..(274): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggnagtcacgacattaacacttattagcctggtatcagcagagccaggganagtccctaaattattgatctctgctgcgtccgcttgcagtcggggtccatctcgttcagtggcggtggatcgtaggacagaattcgactctacaccataccaccaacctgaccaccctagaagattggttaggaacgtttattactgtacagacctagtaggtggtcggacccgtcgtcttaacgttttcgggacggggtaacggggtaccgaaagggttcgacgtaggaacttaacgaaaacgtaacgtaggtagggtcttacggacctaaccg

SEQ ID NO: 389874 - DNA, 570 bp, Homo sapiens
  misc_feature: GZ8MTXP02GKF9Q.13.59.F04.1.454.CMB.2.raw
  modified_base (276)..(276): a, c, t, g, unknown or other
  modified_base (289)..(289): a, c, t, g, unknown or other
  modified_base (298)..(298): a, c, t, g, unknown or other
  modified_base (351)..(351): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagagccaggganagtccaataattntagtatctntgctcgcgtccgtctgaccctacggtcccggggtactacgtcgttcggttcgnggtcgggcgggttaggactcgtaagacaagtacttcactctacacactaccacctaactcaccacctagaaacgtgttaggttaggtaaatttacgttaccgtagtactaacgtacttagtacggttcggccggtcccgtcgttacgttacggtttcggggacgggaacggtaccgaaggtcgagagaactaacgaaacgacgtggtacgacgcaaccg

SEQ ID NO: 389875 - DNA, 521 bp, Homo sapiens
  misc_feature: GZ8MTXP02FXW75.13.59.F04.1.454.CMB.2.raw
  modified_base (344)..(344): a, c, t, g, unknown or other
  modified_base (381)..(381): a, c, t, g, unknown or other
  modified_base (390)..(390): a, c, t, g, unknown or other
  modified_base (414)..(414): a, c, t, g, unknown or other
  modified_base (430)..(430): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacttgccggcagtcacgacattaacacttattagcctggtatcagcagaagccaggagagtaccctaaattattgatctctgctgccgtcgccttgcaacgtcggggtcccatctcgttcagtggcgngatctagacagaattcactctcacatcaccaaccgtnaccacctanaagatagtgaagttattactgtanacgactataggttcgngaccgtctcgtagtttccggaggtacgggaaccgaaacgggtcgacgacgacgtaacgtaaacgtaacgtacgtacggtacgtacgacgac

SEQ ID NO: 389876 - DNA, 606 bp, Homo sapiens
  misc_feature: GZ8MTXP02GUOXA.13.59.F04.1.454.CMB.2.raw
  modified_base (203)..(203): a, c, t, g, unknown or other
  modified_base (233)..(233): a, c, t, g, unknown or other
  modified_base (393)..(393): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcgttgganacagacgtcaccgtcacgttcggcccgggngagtcaacgactattaactacttattacgcctggtatcagcagaagccgagggagacgtaccctaaattattgatctctgtctgccgtccgtctgcgtaaccgtccggggtcctagtcgtcgtcgaggtgggcgtgatcgaggacagtatcactctcacncaccaccacctcgacctacccgtagaacgtagttacggttaggtaatttagttactaggtaccaagtaacttaggtacgtacgggtccggtcccgtacgttcgttaacggtttccggggacggggtaaccgggtaaccggtaagggtacgaccgtaaggtaaactaaccggaaaacccgtaagttcggtacggtcctacggtaccgtaacccg

SEQ ID NO: 389877 - DNA, 493 bp, Homo sapiens
  misc_feature: GZ8MTXP02FK2RA.13.59.F04.1.454.CMB.2.raw
  modified_base (225)..(225): a, c, t, g, unknown or other
  modified_base (388)..(388): a, c, t, g, unknown or other
  modified_base (464)..(464): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggnagtcacgacattaacacttattagcctggtatcagcagaagccaggagagtccctaaattattgatctctgctgcgtccgccttgcaagtcggggtcccatctcggtcagtggcggtggatcgtaggacagaaattcactctcacatcacaactgcaccctanagatgtaggattattactgtcagacctatagtggtgccgctcgtatttcggcggtacgggaccaaggtgacagganaacgaaacgaacgtacgtgtcgcgcaacc

SEQ ID NO: 389878 - DNA, 501 bp, Homo sapiens
  misc_feature: GZ8MTXP02I346X.13.59.F04.1.454.CMB.2.raw
  modified_base (201)..(201): a, c, t, g, unknown or other
  modified_base (225)..(225): a, c, t, g, unknown or other
  modified_base (275)..(275): a, c, t, g, unknown or other
  modified_base (391)..(391): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccggngagtcacgacattaacacttattagcctggtatcagcagaagccaggganagtccctaaattatgatctctgctgcgtccgccttgcaacgtcggggtcccatctcggttcagtgggcgtggatcgtaggacagaattcatctcacatcacaacctgcaccctganatgtaggattattactgtacagacctatagtggtcgccgctctagtttcggacggacgggaccgaaaggtcgacgagagtaacgaaacgtaactgtaggctcgactaacc

SEQ ID NO: 389879 - DNA, 570 bp, Homo sapiens
  misc_feature: GZ8MTXP02HUS8Q.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcagtcacgacattaacacttattagcctggtatcagcagaagccgagggagacgtaccctaaattattagatctctgctgcgtccgccttgcaacgtccggggtcccagtctcggttcagtgggcggtgatcgtagacagtaatcactctcaccatccaccaacctgaccaccctagaacgatgttaggtaaagtttattactagtacagtaacctagtagtggtacgcccggtcttacgtacgttttccggggacgggtaacggggtacccgtaaaagggtcgaacgtaaggtacgttaaaccgaaaacgaacgttacggacggtccgtacggacctaacccg

SEQ ID NO: 389880 - DNA, 517 bp, Homo sapiens
  misc_feature: GZ8MTXP02GZ2YB.13.59.F04.1.454.CMB.2.raw
  modified_base (201)..(201): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagaagccagggagagtccctaaattatgatctctgctgcgtcgccttgcaacgtcggggtccatctcggttcagtggcggtggatcgtagacagaatcactctcaccatccaccaacctgaccaccctagaacgtatgttaggaacgtttattactagtacagacctatagtaggtgcccgctctacgtttcggcggtacgggaccgaaaggtcgacacggataacgaaacgtactaggtgtactcggacacccg

SEQ ID NO: 389881 - DNA, 504 bp, Homo sapiens
  misc_feature: GZ8MTXP02JKQSU.13.59.F04.1.454.CMB.2.raw
  modified_base (387)..(387): a, c, t, g, unknown or other
  modified_base (431)..(431): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattattgatctctgctgcgtccgccttgcaatcggggtccatctcggttcagtggcggtggatcgtaggacagattcatctcacatcacaacctgcaccctnaacgatgttagaagtttatactgtcagactatagtggtgcccgntcattttcggcggtacgggacctagggtcgacgagactaacgaaacgtaaaccgtgtacggctaggccaaccg

SEQ ID NO: 389882 - DNA, 484 bp, Homo sapiens
  misc_feature: GZ8MTXP02H9DWP.13.59.F04.1.454.CMB.2.raw
  modified_base (295)..(295): a, c, t, g, unknown or other
  modified_base (366)..(366): a, c, t, g, unknown or other
  modified_base (380)..(380): a, c, t, g, unknown or other
  modified_base (459)..(459): a, c, t, g, unknown or other
  modified_base (476)..(476): a, c, t, g, unknown or other
  modified_base (479)..(479): a, c, t, g, unknown or other
  modified_base (483)..(483): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctcatcctccctgtctgcatctcttggagacagagtcacgtcacttgccgggcagtcacgacattaacacttattagcctggtatcagcagaagccagggagagtaccctaaattatagatctntgctgcgtccgtaccttgcaacgtcggggtccatctcgttcagtggcggtgatctagacgataactcactntcacatcacaactnacacctgaagatgttaggattatactgtacagactatagtcgtcggcctctctgtttcggcggagtacgaagcgcaganaacgaacgaacgtacgngcncacnc

SEQ ID NO: 389883 - DNA, 545 bp, Homo sapiens
  misc_feature: GZ8MTXP02HJGST.13.59.F04.1.454.CMB.2.raw
  modified_base (201)..(201): a, c, t, g, unknown or other
  modified_base (215)..(215): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggcgagtcacgacattaacacttattagcctggtatcagcagaagccagggagagtccctaaattatgatctctgctgcgtccgccttgcaacgtcggggtcccatctcggttcagtggcgtggatcgtaggacagtaattcactctcaccatccaaccaacctcgaccaccctagaaagtattgttaggtaaagtttattaactgtacaagtacctagtacgtggtcgcccgtctcgtacgtttcgggacggacgggaacccgaaagggtcgaccgaagacgtaaccgaaaacgaaaccttggacggactacgacctaacc

SEQ ID NO: 389884 - DNA, 537 bp, Homo sapiens
  misc_feature: GZ8MTXP02JC83P.13.59.F04.1.454.CMB.2.raw
  modified_base (201)..(201): a, c, t, g, unknown or other
  modified_base (227)..(227): a, c, t, g, unknown or other
  modified_base (276)..(276): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggnagtcacgacattaacacttattagcctggtatcagcagaagccaggganagtaccctaaattactgatctctgctgccgtccgctgcaacgtcggggtccatcgtcgttcagtgggcgtgatcgagacagattcactctacacatcaccaacctgaccaccctagaacgtagttagttaggtaaagtttattacgtagtacagtacctagttaggtcggtcggcccgtgtactacgttttcgggacgggtaacgggacctaagggtcgaccgagtaacaaccgaaaagtactggtagccgtgacctaccg

SEQ ID NO: 389885 - DNA, 498 bp, Homo sapiens
  misc_feature: GZ8MTXP02JYKPL.13.59.F04.1.454.CMB.2.raw
  modified_base (392)..(392): a, c, t, g, unknown or other
  modified_base (394)..(394): a, c, t, g, unknown or other
  modified_base (409)..(409): a, c, t, g, unknown or other
  modified_base (429)..(429): a, c, t, g, unknown or other
  modified_base (492)..(492): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggcgagtcacgacattaacacttattagcctggtatcagcagaagccagggagagtaccctaaattattgatctctgctgcgtccgccttgacaacgtcggggtccatctcggttcagtggcggtggatcgtaggacagaatcactctcacatcacacctgcacctnanatgtgattatatgtnagacctatagtgtcggccgntctacgtttcgggcggtagggaccaagggtcgcgaagactaacgaaaacgtactaggtgcgtnacaacc

SEQ ID NO: 389886 - DNA, 517 bp, Homo sapiens
  misc_feature: GZ8MTXP02HH7OT.13.59.F04.1.454.CMB.2.raw
  modified_base (225)..(225): a, c, t, g, unknown or other
tcagtcacgtactacacgaccggtgctcgatttagtacacacacttagggattgggggcagaagtctctctcagtcaggacacagcatggacatgagggtccctgctcagttcctgggactcctgctgctctggctcccagataccagatgtgacatccagatgacccagtctccatcctccctgtctgcatctcttggagacagagtcaccgtcacttgccggngagtcacgacattaacacttattagcctggtatcagcagaagccaggagagtccctaaattatgatctctgctgcgtccgccttgcaagtcccgggggtcccagtctcggttcaggtggcggtggatcgaggacagattcactctcacatcaccaacctgcaccctagacgattgttaggtaagttatttactgtcaagcctagtagtggtcgcccgctcgtagttttcggacggtagggaccgaaaggtgacgaggactacgaaacgaacgtgtacggctacggcactacg

SEQ ID NO: 389887 - DNA, 392 bp, Homo sapiens
  misc_feature: GZ8MTXP02JSU7F.13.59.F04.1.454.CMB.2.raw
  modified_base (309)..(309): a, c, t, g, unknown or other
  modified_base (319)..(319): a, c, t, g, unknown or other
  modified_base (324)..(324): a, c, t, g, unknown or other
  modified_base (330)..(330): a, c, t, g, unknown or other
  modified_base (334)..(334): a, c, t, g, unknown or other
  modified_base (384)..(392): a, c, t, g, unknown or other
tcagtcacgtactacacgaccggtgctcgatttagtacacacacttagggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggctactttgatatcgtggggccaagggtcgatggtcatcgtctcttcagcctcacaggcccatcggtctcccctgcgcctgctcagngcacctcgangcacngcgccnggcngctgcaggctactctagtcgtgactgagcgggctggcaaggcgcagtagnnnnnnnnn

SEQ ID NO: 389888 - DNA, 522 bp, Homo sapiens
  misc_feature: GZ8MTXP02IN5WS.13.59.F04.1.454.CMB.2.raw
  modified_base (201)..(201): a, c, t, g, unknown or other
  modified_base (368)..(368): a, c, t, g, unknown or other
  modified_base (391)..(391): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagaagccagggagagtccctaaattattgatctctgctgcgtccgccttgcaatcggggtcccatctcggttcagtgggcgtggatctaggacagaattcactctnaccatcaccacctgcaccctganatgttgaagtttattactgtacagacctatagtggtggcccgctcgtacgttttcgggacggtacggggtaccgaaaggttcgacgaagactaacgtaaaacggaacttaggtcggacttcggactaaacc

SEQ ID NO: 389889 - DNA, 613 bp, Homo sapiens
  misc_feature: GZ8MTXP02I4T3Q.13.59.F04.1.454.CMB.2.raw
  modified_base (200)..(200): a, c, t, g, unknown or other
  modified_base (214)..(214): a, c, t, g, unknown or other
  modified_base (225)..(225): a, c, t, g, unknown or other
  modified_base (274)..(274): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtnacttgccgggnagtcacgacattaacacttattagcctggtatcagcagaagccaggganagtccctaaattatgatctctgctgccgtcgccttgcaacgtcggggtccatctcggttcagtggcgtggatgtagacagatcactctcaccatcacctaacctgaccaccctagaacgtagttaggttaggtaagtttaactttaaccttgggttacctaacggtaacccttaaacgttagggttacggggtttcgggacccccgggtacttccgttaaacggtttttccggggaccgggggttaaacggggaaccccgtaaaaggggttcgaaccgtaaggaacttaaccgaaaaacggtaaaccgtgggtaacggtaccgtcggtacctaaacccg

SEQ ID NO: 389890 - DNA, 540 bp, Homo sapiens
  misc_feature: GZ8MTXP02GAKMB.13.59.F04.1.454.CMB.2.raw
  modified_base (203)..(203): a, c, t, g, unknown or other
  modified_base (217)..(217): a, c, t, g, unknown or other
  modified_base (229)..(229): a, c, t, g, unknown or other
  modified_base (281)..(281): a, c, t, g, unknown or other
tcagtcacgtactacacgaccggtgctcgatttagtacacacacttagggattgggggcagaagtctctctcagtcaggacacagcatgggacatgagggtccctgctcagctcctgggactcctgctgctctggctcccagataccagatgtgacatccagatgacccagtctccatccctccctgtctgcatctcttgganacagagtcaccgtnacttggccgggnagtcacgacattaacacttattagcctggtatcagacagaacgccgaggganacgtaccctaaattattgatctctgctgtccgtccgctgctacgtcggggtccatcgtcggttcagtggcggtgatcgtagacagtattcactctcacatacacccactcgaccaccctagaacgagttgttaggtaagtttattactgttacacgtacctagtacggtggtcgtccgtcgtctacgtttcgggacggtacgggaccgaaggtcgacgacgtaataaccgaaacgaacgtggtcgtactcgacctaacg

SEQ ID NO: 389891 - DNA, 488 bp, Homo sapiens
  misc_feature: GZ8MTXP02II1HB.13.59.F04.1.454.CMB.2.raw
  modified_base (366)..(366): a, c, t, g, unknown or other
  modified_base (385)..(385): a, c, t, g, unknown or other
  modified_base (438)..(438): a, c, t, g, unknown or other
  modified_base (449)..(449): a, c, t, g, unknown or other
  modified_base (468)..(468): a, c, t, g, unknown or other
  modified_base (478)..(478): a, c, t, g, unknown or other
  modified_base (480)..(480): a, c, t, g, unknown or other
  modified_base (483)..(483): a, c, t, g, unknown or other
  modified_base (485)..(485): a, c, t, g, unknown or other
  modified_base (487)..(487): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccaggagagtaccctaaatattgatctctgctgcgtccgccttgcaactcgggggtcccatctcggttcagtggcggtgatcgtaggacagaatctanctcacatcaaccaacctanccaccctgaaagatagttaggaatttattactgtacagactatagtgtgccgntctatttcggnggacgacgaagtgcagaanaagaacgacngngcncncnc

SEQ ID NO: 389892 - DNA, 544 bp, Homo sapiens
  misc_feature: GZ8MTXP02FVBCM.13.59.F04.1.454.CMB.2.raw
  modified_base (293)..(293): a, c, t, g, unknown or other
  modified_base (375)..(375): a, c, t, g, unknown or other
  modified_base (415)..(415): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggcagtcacgacattaacacttattagcctggtatcagcagagccaggagagtccctaaattattgatctntgctgcgtccgcttgcaacgtcggggtccatctcgtcagtggcgtgatgtaggacagattcatctcacactacaccaacctnacaccctagaatatgttaggtaagttatttactcggttanacgtacctaagtagttggttcggcccgtctcgtacgttttacggcgggaacgggtaaaccgaaagggttccgacgtacggtaaaacgtaacgtaaacgtaacgtacggtacggtacgtacgtacgtacg

SEQ ID NO: 389893 - DNA, 496 bp, Homo sapiens
  misc_feature: GZ8MTXP02HCLT4.13.59.F04.1.454.CMB.2.raw
  modified_base (377)..(377): a, c, t, g, unknown or other
  modified_base (382)..(382): a, c, t, g, unknown or other
  modified_base (385)..(385): a, c, t, g, unknown or other
  modified_base (404)..(404): a, c, t, g, unknown or other
  modified_base (440)..(440): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgcttgcaacgtcggggtccatctcggttcagtggcggtgatctagacagaatcactctcacatcaccactncaccnganatgtagagtttatatgtanacgactatagtggtcggccgtctccgtagtttcggnggacgggaccaaggtgaccgaagataacgaaacgaacgtgtaggctcgactaaccg

SEQ ID NO: 389894 - DNA, 530 bp, Homo sapiens
  misc_feature: GZ8MTXP02JR832.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagaagccagggagagtaccctaaattatgatctctgctgcgtccgtctgcaacgtccggggtccatctcggttcagtggcggtggatcgtagacagtattcactctcacatacaccaacctcgaccacctagaagtatgttaggtaagtttattacgtgttacagtacctagtaggtggtcggcccgtctcgttacgtttcgggacgggtacgggaccgaagggtcgcgaagataacgaaaacgacgtaggtcggactcggacctacc

SEQ ID NO: 389895 - DNA, 559 bp, Homo sapiens
  misc_feature: GZ8MTXP02FRL1M.13.59.F04.1.454.CMB.2.raw
  modified_base (201)..(201): a, c, t, g, unknown or other
  modified_base (215)..(215): a, c, t, g, unknown or other
  modified_base (226)..(226): a, c, t, g, unknown or other
  modified_base (273)..(273): a, c, t, g, unknown or other
  modified_base (454)..(454): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggnagtcacgacattaacacttattagcctggtatcagcagagccagganagtcctaaattatgatctctgctgcgtccgcttgcaacgtcggggtccagtctcggttcacgtggcgtggatcgtagacagattcatctacacatcaaccaaccttgacctaccgttagaagtagttgttaggtaagttatttacctggtacacgaccttagtaggttggtcggtcccgtntccgttaacggttttcggggacgggacggggtaaccctaaagggtcgaccgaaggtaactaacgaaaaacccgtaacgtaggttacgggactcggactaaacccg

SEQ ID NO: 389896 - DNA, 515 bp, Homo sapiens
  misc_feature: GZ8MTXP02G7L8U.13.59.F04.1.454.CMB.2.raw
  modified_base (450)..(450): a, c, t, g, unknown or other
  modified_base (505)..(505): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcagtcacgacattaacacttattagcctggtatcagcagaagccagggagagtccctaaattattgatctctgctgcgtccgcttgcaacgtcggggtcccatctcggttcaggtggcggtggatcgtaggacagaattcactctcacatccaccaactcgacaccctagaagtatgttaggtaagtttattactgtacagtaacctagtagtaggtcgcccgntcgtacgttttcggcggtacgggaccgaaggtcgacagactaacaaaacgactgngctcgacacc

SEQ ID NO: 389897 - DNA, 607 bp, Homo sapiens
  misc_feature: GZ8MTXP02JFGB9.13.59.F04.1.454.CMB.2.raw
  modified_base (226)..(226): a, c, t, g, unknown or other
  modified_base (278)..(278): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccggngagtcacgacattaacacttattagtcctggtatcagcagaagccgaggganacgtacctaaattattagatctctgtctgtcgtccgtccttggccaaccggtccgggggtacccacgttccgttcggttccgaggtcggggtcggtggacgtcgtaggactagtacttcactctaccacactaccaccaacctcgaccaaccctagaacgtagtgttaggtaagtttattactgtacacgtacttagtacggttggtcgtcccgtcttacgttacggtttcgggacgggtaaaccggggtaccgtaaagggtacgaccggtaataacgttaaacgaaaacggtaaaccgtgggttaacggcgttaacggcctaaacccg

SEQ ID NO: 389898 - DNA, 548 bp, Homo sapiens
  misc_feature: GZ8MTXP02I0I1R.13.59.F04.1.454.CMB.2.raw
  modified_base (368)..(368): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattatgatctctgctgcgtccgccttgcaagtcggggtcccatctcggttcagtggcggtggatcgtaggacagaattcactntcaccatccacaacctgcaccctgaacgatggttaggaagtttattactgtacagtaccttagtagtcggttcggacccgcgttctacgttttcgggcgggtaacggggacccgaaagggttcgacgtaacgaacgtaaccgaaaacgtaaacgtcgtggggtaccttcggactaacccg

SEQ ID NO: 389899 - DNA, 614 bp, Homo sapiens
  misc_feature: GZ8MTXP02GZWBU.13.59.F04.1.454.CMB.2.raw
  modified_base (334)..(334): a, c, t, g, unknown or other
  modified_base (352)..(352): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcagtcacgacattaacacttattagcctggtatcagcagaagccagggagagtccctaaattatgatctctgctgcgtccgccttgcaacgtcggggtccatctcgtnagtggcggtgatctaganagaattcactctcaccatccacccaaacctcgacctaacccctagaaacgtagttaggttaggtaaaggttttacttaaccgttaggttacaaacggtacccttaagttaacggttacggggttacggacccccggtcttaccgttaacggtttttccggggacggggttaacggggacccgtaaaaggggtcgacgaacggttaacgtaaccgaaaaaccggtaaaccgttgggaacggttcgtcggaaccttaaaccccg

SEQ ID NO: 389900 - DNA, 523 bp, Homo sapiens
  misc_feature: GZ8MTXP02I43ZH.13.59.F04.1.454.CMB.2.raw
  modified_base (215)..(215): a, c, t, g, unknown or other
  modified_base (226)..(226): a, c, t, g, unknown or other
  modified_base (335)..(335): a, c, t, g, unknown or other
  modified_base (508)..(508): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattacacttattagcctggtatcagcagaagccagggagagtccctaaattattgatctctgctgcgtcgccttgcaacgtcggggtccatctcggtacngtggcgtggatcgtagacagaattcactctcacatcaccacctgccaccctgagatgttaggaagtttattactgttacacgacctataggtggtcggtccgcttcgtacgttttcgggacggtacgggaccgaacgggttgaccgaggacttaaccgaaaacgaacgttggnggtccgtacgactac

SEQ ID NO: 389901 - DNA, 510 bp, Homo sapiens
  misc_feature: GZ8MTXP02FPPNY.13.59.F04.1.454.CMB.2.raw
  modified_base (425)..(425): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacactatttagcctggtatcagcagaagccagggagagtccctaaatattgatctctgctgcgtccgccttgcaactcggggtccatctcggtcagtggcggtggatctaggacagaattcactctcacatcaccaactgcaccctagaacgatgttggaaagttattactgtcacgacctatagnggtggcccgctctattttcggcggtacgggaccaaagggtcgacaggtactaacgaaaacgaacttagtcggactcgacaacccg

SEQ ID NO: 389902 - DNA, 512 bp, Homo sapiens
  misc_feature: GZ8MTXP02F2AFO.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgccttgcacgtcggggtccatctcgttcagtggcggtggatcgtaggacagattcactctcacatccacaacctcgcacccagaagatgttagtaagtttattactgtacagacctataggtggtacgcccgtctcgtacgtttcgggacggacgggaccgaaggtcgacagataacgaaacgaacgtcgtcgctcggactaaccg

SEQ ID NO: 389903 - DNA, 564 bp, Homo sapiens
  misc_feature: GZ8MTXP02GH3ZF.13.59.F04.1.454.CMB.2.raw
  modified_base (227)..(227): a, c, t, g, unknown or other
  modified_base (276)..(276): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggnagtcacgacattaacacttatttagcctggtatcagcagaagcaggganagtcctaaattatgatctctgctgcgtccgcttgcaagtcggggtcccatctcggttcagtggacgtggatcgtagacagaattcactctacacatccaccaacctcgaccaccctagaacgtagttaggttaggttaaggtttactttacgtggttacgactaccgttagtaggttcgggtcggcccgtcgttcttaacggttttccggggacggtacggggtaacccgaaagggttcggacgaggtaaacaacgtaaaaccgaagtcggtgactacggactaaccg

SEQ ID NO: 389904 - DNA, 521 bp, Homo sapiens
  misc_feature: GZ8MTXP02IG051.13.59.F04.1.454.CMB.2.raw
  modified_base (200)..(200): a, c, t, g, unknown or other
  modified_base (225)..(225): a, c, t, g, unknown or other
  modified_base (276)..(276): a, c, t, g, unknown or other
  modified_base (296)..(296): a, c, t, g, unknown or other
  modified_base (449)..(449): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctgganacagagtcaccgtcacttgccgggnagtcacgacattaaactacttattagcctggtatcagcagaagccgagganagtacctaaattatgatctntgctgcgtccgccttgctaacgtcggggtccatcgtcgttcagtgggcggtgactcgtagacagtacttcactctacaccatccaccaacctgaccacccgtagaagattcggtagtaagtttatactgtacagtacctatagtggtcgcctntcgtacgtttcggcggacggtaccgaaggtcgacgagacgtaacgaaacgtaacgtgtaggctagactaccg
